United States Patent 9,107,886 (MODIFIED POLYNUCLEOTIDES ENCODING BASIC HELIX-LOOP-HELIX FAMILY MEMBER E41) - sequence listing, part 2

SEQ ID NO: 358 - DNA, 1975 bp, Homo sapiens
gaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 359 - DNA, 1759 bp, Homo sapiens
aagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaagg

SEQ ID NO: 360 - DNA, 1659 bp, Homo sapiens
tgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaacttctattgacccacaaagtttcagaaattctctgaaagtttcttccttttttctcttactatatttattgatttcaagtcttctattaaggacatttagccttcaatggaaattaaaactcatttaggactgtatttccaaattactgatatcagagttatttaaaaattgtttatttgaggagataacatttcaactttgttcctaaatatataataataaaatgattgactttatttgca

SEQ ID NO: 361 - DNA, 1760 bp, Homo sapiens
aaaaaggaggagcttcaacctgtgtgcaaaatctgggaacctgacagtataggttgggggccaggatgaggaaaaaggaacgggaaagacctgcccacccttctggtaaggaggccccgtgatcagctccagccatttgcagtcctggctatcccaggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagactaga

SEQ ID NO: 362 - DNA, 883 bp, Homo sapiens
ctgtcagctgaggatccagccgaaagaggagccaggcactcaggccacctgagtctactcacctggacaactggaatctggcaccaattctaaaccactcagcttctccgagctcacaccccggagatcacctgaggacccgagccattgatggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctgaagccagaggctgtttactatgacatctcctctttatttattaggttatttatcttatttatttttttatttttcttacttgagataataaagagttccagagg

SEQ ID NO: 363 - DNA, 1312 bp, Homo sapiens
gaggcttccaaggcaggatacttgtgtctcagatgcggtcgcttctttcatacagcaattgccgccttgctgaggatcaaggaacctcagtgtcagatcacgccctccccccaaacttagaaattcagatggggcgcagaaatttctcttgttctgcgtgatctgcatagatggtccaagaggtggtttttccaggagcccagcacccctcctccctccgactcagacccaggagtctggccctccattgaaaggaccccaggttacatcatccattcaggctgcccttgccacgatggaattctgtagctcctgccaaatgggtcaaatatcatggttcaggcgcagggagggtgattgggcgggcctgtctgggtataaattctggagcttctgcatctatcccaaaaaacaagggtgttctgtcagctgaggatccagccgaaagaggagccaggcactcaggccacctgagtctactcacctggacaactggaatctggcaccaattctaaaccactcagcttctccgagctcacaccccggagatcacctgaggacccgagccattgatggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctgaagccagaggctgtttactatgacatctcctctttatttattaggttatttatcttatttatttttttatttttcttacttgagataataaagagttccagaggaggataa

SEQ ID NO: 364 - DNA, 1959 bp, Homo sapiens
tggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccaaattctgcaaaaaaataaaaataagccacaaaactaaaaggcctggccccattctggaaaaggcaaagctgcatgagacacagccttctgcctcctcgcctctcctggactggcttcctctttgagaaaatgcacaaagccctgggagatgacaagcacaaggactgactcaagctgtgtctttcagaccaaggaacatcagagaagctgtggggctgcctgccaggcaggatcatggctgccatcaagccttttctggatccagccatcaaggacatgtttgtggtgtgatgcacacttttgcaagcgtgtaagatgttacctggtttgtctcttttggaaaacaaaaatcagaaggctgcattctagagggcagagaaattcccccgaagactgagctggttgcctgcatcctctatcttctttgacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtgcttgatgagggaaggtagactcttccctaggactgacgagttacggctgccagatgcctgcatgggaagaggtggacatctgcatcttccattggtggtcaaggatgggtgtgggagaaccacacctagtgcaagcctggtactcagtaaatatttgttgaaatgaatgataagagcattggtccccaagccagagagccagaagccatcacccaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggagaggtccttacctctgatccacttagagcaataaccactttttaaatgtaaaataaaaagacaaatgaaaaggca

SEQ ID NO: 365 - DNA, 2732 bp, Homo sapiens
gcggccgccgggcgccggagccgcgtccccctgcgccgccccgggcctgccggccggaggagccaccatacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagatatgaaaaccttttcagtgcttgccctcagcagctaagaagacagacagtagagaatgtgagaggatctcatggttctgatgatgattatccaacaaacatctggccctctctacatctcttccctccatctccttgtaccctctggcttactgtcctctctctggcgcactttcctgaagcctcttattaactcccatctccagaagcacctcaacaatgtcagtggctgaggctgcactcagagggatgactgctgggggtagactgggtgccaggggccatgggcccaggacccagtcttggccattcagttgagtgaggctgaaggctgggtttgaaaaggcaaaaagacaagacatccaggcagggcttctcttttctttccacaagggacaagagcttggcttatttaggctacagccctgctgctgctcccttccttcttctgtcctgtttccagccttgcaagaaggctattcacaattaggcctggctgcttctctcatttttttcctcccagtttccaaacaagccctcagtgaacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccaaattctgcaaaaaaataaaaataagccacaaaactaaaaggcctggccccattctggaaaaggcaaagctgcatgagacacagccttctgcctcctcgcctctcctggactggcttcctctttgagaaaatgcacaaagccctgggagatgacaagcacaaggactgactcaagctgtgtctttcagaccaaggaacatcagagaagctgtggggctgcctgccaggcaggatcatggctgccatcaagccttttctggatccagccatcaaggacatgtttgtggtgtgatgcacacttttgcaagcgtgtaagatgttacctggtttgtctcttttggaaaacaaaaatcagaaggctgcattctagagggcagagaaattcccccgaagactgagctggttgcctgcatcctctatcttctttgacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtgcttgatgagggaaggtagactcttccctaggactgacgagttacggctgccagatgcctgcatgggaagaggtggacatctgcatcttccattggtggtcaaggatgggtgtgggagaaccacacctagtgcaagcctggtactcagtaaatatttgttgaaatgaatgataagagcattggtccccaagccagagagccagaagccatcacccaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggagaggtccttacctctgatccacttagagcaataaccactttttaaatgtaaaataaaaagacaaatgaaaaggca

SEQ ID NO: 366 - DNA, 1698 bp, Homo sapiens
acagctcttgccaggcaaggcagccgaccacaggtgagtcttggcatctaccgttttcaagtgaccaggatgaagacactccagtttttcttccttttctgttgctggaaagcaatctgctgcaatagctgtgagctgaccaacatcaccattgcaatagagaaagaagaatgtcgtttctgcataagcatcaacaccacttggtgtgctggctactgctacaccagggatctggtgtataaggacccagccaggcccaaaatccagaaaacatgtaccttcaaggaactggtatacgaaacagtgagagtgcccggctgtgctcaccatgcagattccttgtatacatacccagtggccacccagtgtcactgtggcaagtgtgacagcgacagcactgattgtactgtgcgaggcctggggcccagctactgctcctttggtgaaatgaaagaataaagatcagtggacatttcaggccacatacccttgtcctgaaggaccaagatattcaaaaagtctgtgtgtgtgcaatgtgcccaggggacaaaccactggatcaggggattcagactctactgatccctggtctactggcagagggaactctgggaattgagagtgctgggggccaggactccatcatgattcagctctatattcctaggtctgatttcataaggtttattcagtcttaactcacagacttgtgcctggtttcttctttaaaaatcttagaaatcttctcaggcaatgcctctctcttagggggaaacataagcctagaaggaggaagcagtaatgggagtgagtgaaagaactaactgcagcagtcttctggtagactcttgggccctctagagcaaggtcagcatcttcagcattgtagcgtcaatgcctagcactctgcctggaacttagaaacacaacaatgacttctttagatcagaaaggtcaagggtagaaaatactggaagacgatgtttgaggtaagctgatgaggctgcccgcagccacaccagtcccatgaaagttagtggcatcagttccacctcgccttttctccagcacatggagtattgagacatgatgtatctttctgaattgtttggtacagatggggagtaacagagctcaagatttccaagctattactaccaagcctgttagttaagggcaaaggcaagaaattgtaatttggggctgtggaaattagcctgcctctattcattacttaaacaaattgatcacatgctactaggctcctgcaaaactcctttttgagataaagggaaaaaaccaaactatctcaccctaccctccctaggatccacttctttggaatgacaaaggatttgaaagtaggtttgaaagcagtttcagcaatttaataaatataattaatttgtctacaaatatatttgtataaataaatagctcctttagaaagaattagccatgggggacgaggggaaactgctgttttctaggatcctgtctacatcaatcttctattttatccatccatgttctcccaaatctgtgctttctttcaacaggttatatattaaaactatttcatgagttgatttcttttaaacgtgttaactgtcttagttatgcactcagtttcacactcatattgtttaactaatttatttaaatcttatttttttaataaagatgctagccaccaga

SEQ ID NO: 367 - DNA, 1890 bp, Homo sapiens
acagctcttgccaggcaaggcagccgaccacagaccaggatgaagacactccagtttttcttccttttctgttgctggaaagcaatctgctgcaatagctgtgagctgaccaacatcaccattgcaatagagaaagaagaatgtcgtttctgcataagcatcaacaccacttggtgtgctggctactgctacaccagggatctggtgtataaggacccagccaggcccaaaatccagaaaacatgtaccttcaaggaactggtatacgaaacagtgagagtgcccggctgtgctcaccatgcagattccttgtatacatacccagtggccacccagtgtcactgtggcaagtgtgacagcgacagcactgattgtactgtgcgaggcctggggcccagctactgctcctttggtgaaatgaaagaataaagatcagtggacatttcaggccacatacccttgtcctgaaggaccaagatattcaaaaagtctgtgtgtgtgcaatgtgcccaggggacaaaccactggatcaggggattcagactctactgatccctggtctactggcagagggaactctgggaattgagagtgctgggggccaggactccatcatgattcagctctatattcctaggtctgatttcataaggtttattcagtcttaactcacagacttgtgcctggtttcttctttaaaaatcttagaaatcttctcaggcaatgcctctctcttagggggaaacataagcctagaaggaggaagcagtaatgggagtgagtgaaagaactaactgcagcagtcttctggtagactcttgggccctctagagcaaggtcagcatcttcagcattgtagcgtcaatgcctagcactctgcctggaacttagaaacacaacaatgacttctttagatcagaaaggtcaagggtagaaaatactggaagacgatgtttgaggtaagctgatgaggctgcccgcagccacaccagtcccatgaaagttagtggcatcagttccacctcgccttttctccagcacatggagtattgagacatgatgtatctttctgaattgtttggtacagatggggagtaacagagctcaagatttccaagctattactaccaagcctgttagttaagggcaaaggcaagaaattgtaatttggggctgtggaaattagcctgcctctattcattacttaaacaaattgatcacatgctactaggctcctgcaaaactcctttttgagataaagggaaaaaaccaaactatctcaccctaccctccctaggatccacttctttggaatgacaaaggatttgaaagtaggtttgaaagcagtttcagcaatttaataaatataattaatttgtctacaaatatatttgtataaataaatagctcctttagaaagaattagccatgggggacgaggggaaactgctgttttctaggatcctgtctacatcaatcttctattttatccatccatgttctcccaaatctgtgctttctttcaacaggttatatattaaaactatttcatgagttgatttcttttaaacgtgttaactgtcttagttatgcactcagtttcacactcatattgtttaactaatttatttaaatcttatttttttaataaagatgctagccaccagagtcacaggcttggattgttttatgtacaaacagatgacttagatattctgtattttataatattagtggaatgaaatcttaaaatataattcccagtgtttctataaatattacctttccttatctttggagatattaaaaataattttgttggatttctgaagtgttttgtcacttaaatttcctgtcattttttgaagacattttctgatgtaatttggg

SEQ ID NO: 368 - DNA, 1368 bp, Homo sapiens
tgggcttcattgtttgcttcccagaccaggatgaagacactccagtttttcttccttttctgttgctggaaagcaatctgctgcaatagctgtgagctgaccaacatcaccattgcaatagagaaagaagaatgtcgtttctgcataagcatcaacaccacttggtgtgctggctactgctacaccagggatctggtgtataaggacccagccaggcccaaaatccagaaaacatgtaccttcaaggaactggtatacgaaacagtgagagtgcccggctgtgctcaccatgcagattccttgtatacatacccagtggccacccagtgtcactgtggcaagtgtgacagcgacagcactgattgtactgtgcgaggcctggggcccagctactgctcctttggtgaaatgaaagaataaagatcagtggacatttcaggccacatacccttgtcctgaaggaccaagatattcaaaaagtctgtgtgtgtgcaatgtgcccaggggacaaaccactggatcaggggattcagactctactgatccctggtctactggcagagggaactctgggaattgagagtgctgggggccaggactccatcatgattcagctctatattcctaggtctgatttcataaggtttattcagtcttaactcacagacttgtgcctggtttcttctttaaaaatcttagaaatcttctcaggcaatgcctctctcttagggggaaacataagcctagaaggaggaagcagtaatgggagtgagtgaaagaactaactgcagcagtcttctggtagactcttgggccctctagagcaaggtcagcatcttcagcattgtagcgtcaatgcctagcactctgcctggaacttagaaacacaacaatgacttctttagatcagaaaggtcaagggtagaaaatactggaagacgatgtttgaggtaagctgatgaggctgcccgcagccacaccagtcccatgaaagttagtggcatcagttccacctcgccttttctccagcacatggagtattgagacatgatgtatctttctgaattgtttggtacagatggggagtaacagagctcaagatttccaagctattactaccaagcctgttagttaagggcaaaggcaagaaattgtaatttggggctgtggaaattagcctgcctctattcattacttaaacaaattgatcacatgctactaggctcctgcaaaactcctttttgagataaagggaaaaaaccaaactatctcaccctaccctccctaggatccacttctttggaatgacaaaggatttgaaagtaggtttgaaagcagtttcagcaatttaataaatataattaattt

SEQ ID NO: 369 - DNA, 1471 bp, Homo sapiens
ggaagggcgggcgagactgtggaggacctggagctggcgggggtcagggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcact

SEQ ID NO: 370 - DNA, 2152 bp, Homo sapiens
cggggcggggctctggaagggcgggcgagactgtggaggacctggagctggcgggggtcagggtaggggggaggggcagggctcggggttcgggggcggggtgttcacggtgagaccaaaagtcaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgcagctgtgtccacttatgatcgtgatttgatccagtgggtcaaggtgtgtaaagcctccctgccagatattcattaatatgttttctcactcttattagtgaggtcaggggtctttgtgggattttcttattagacatcccaggcctcctggtattccatggaatttgaaaagagactggcacctgtagtagtcagggctctccagagaaatagaaccaaggagaaagagatcgatttattgattgattgattgattttaagcaaattggcttctgggattctggagggtggcaagcccaaaacctgctgggtgggttgctggctggagacccaaggaagagctgcagtttgagtctgaagcagtctgctgtcaaaatttcctcttcctctgggaagtgagtcattgtttggtgaaggccatcaactgattagatgaggcccagccacactgtgggggtcttctgctttactccactgatttaagttttatttcacctaaaaagtactttcttagaaacatgtagaatagcatttgagcaaatatttgggtaccttagtctagccaaattaatacagaaaactgcccatcaca

SEQ ID NO: 371 - DNA, 1549 bp, Homo sapiens
aaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgc

SEQ ID NO: 372 - DNA, 1361 bp, Homo sapiens
cccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggta

SEQ ID NO: 373 - DNA, 1247 bp, Homo sapiens
cggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatgcgggacaggctgttccccacgttggaagggaggaagcgaggaagtggccgggagagggtgcgcggccgcctcttggctcaagcccgccctctgggggctggggctcctcgccttcaacctgggagcatgttccccttaaactgtgaggccctgtgtgccacgcagaaggggacactccgcgcctccggccaccgtggggccccaaccgcagacctgggcgaacgtagccttctggcccagcccgttcaatttacagaggaggaaacggggggcgctttccgccccatctgcagcttggggagtgcacaggctagctctcccccttgccccacagctcagggcagagtccaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggccgatggagccaaggtgctgtgcttgtga

SEQ ID NO: 374 - DNA, 1379 bp, Homo sapiens
atgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctcc

SEQ ID NO: 375 - DNA, 1866 bp, Homo sapiens
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaa

SEQ ID NO: 376 - DNA, 2363 bp, Homo sapiens
aggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttga

SEQ ID NO: 377 - DNA, 1511 bp, Homo sapiens
ggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgaccgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactag

SEQ ID NO: 378 - DNA, 2048 bp, Homo sapiens
atggcggcggttgtcgcggcgacgaggtggtggcagctgttgctggtgctcagcgccgcggggatgggggcctcgggcgccccaggacagagggcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttg

SEQ ID NO: 379 - DNA, 1768 bp, Homo sapiens
gcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaatatcagaggagtgtgaaccttcagagatctagggttaaaagctaaaggcatagctccagctacaacttttctttgtctacagatgtgtaaaatcttgatgcaaaaatctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaaggg

SEQ ID NO: 380 - DNA, 1164 bp, Homo sapiens
gtgtggacggagaaagtgaaaggtgaggcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctg

SEQ ID NO: 381 - DNA, 1164 bp, Homo sapiens; identical to SEQ ID NO: 380

SEQ ID NO: 382 - DNA, 1318 bp, Homo sapiens
atgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgtt

SEQ ID NO: 383 - DNA, 314 bp, Homo sapiens
taatacgactcactatagggaaataagagagaaaagaagagtaagaagaaatataagagccaccatgggggtccggcatcccccatgctcccacagactgctggctgtatgtgcactcgtgtcgctcgcgacagccgcgcttttgccgcagaactcaaagatccccggacctacgttcttggacccgcactgataagctgccttctgcggggcttgccttctggccatgcccttcttctctcccttgcacctgtacctcttggtctttgaataaagcctgagtaggaaggcggccgctcgagcatgcatctaga

SEQ ID NO: 384 - DNA, 317 bp, Homo sapiens
taatacgactcactatagggaaataagagagaaaagaagagtaagaagaaatataagagccaccatgggagtacggcatccaccttgctcgcacagattgctcgcggtctgtgccttggtgtcactggctaccgcggcacttctcgccaacacgccgtgtgggccctacacacacgactgccccgtgaagaggtgataagctgccttctgcggggcttgccttctggccatgcccttcttctctcccttgcacctgtacctcttggtctttgaataaagcctgagtaggaaggcggccgctcgagcatgcatctaga

SEQ ID NO: 385 - DNA, 3810 bp, Homo sapiens
ccgcctccagcgcgcccttgctgccccgcgcgaccccaggattgcgaactcttgcccctgacctgttgggcggggctccgcgctccagccatcagcccggatgggtctcctggctgggacttggggcacctggagttaatgtccaacctagggtctgcggagacccgatccgaggtgccgccgccggacgggactttaagatgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctgactccggctccagagactgctgtgtattgcattcctgctacagtgcaaagaaagggaccaaggttcccaggaaatgtttgcccagaatggaagatgaggaccaaggaggcggaggaggaggaagaagaagaggaggaggaggaggaggaggaggaggaggaggaaggcagccatcatgggagcctggtagagggagatccagctacagacaactggacaggagagagagaaaacagccctctggattctccaggatggcagccgatgtcactagaagctcagggctgatgttcctggttggctattgccaccatttcagctgatacagtccaccatcactgattaccggcgcggttgcggtggatgcacttgaaccaaaccagtgtatctcctgtgatttgttttcatgtgtccgaagacaccagggaaacagagatcctggtgttgttccttgttattacgttttactgctgaaagtaagaggtttatttttctgtcactcagtggagacataccctggaaaggagaggggaaaaaaaaagcaaagatacaagagataatcacctttgcatttgaaagttgaggcccgaggtttactacaaccagcatttttgccaacggttggtgattgatttccatcacggtgtgtggggtgggaagaagttggctaggaaccaaaaaggctgtgctcatgattaaacacaaacctgaaggtatttcctttatgtccttggaaacaggaaacgagttgtggttttcgccagcattcttgtaggagagaatcggggaaggccccgaactgcccccgggcagggagagcccctcaggcctgttggtttacagagagacagatgttacataaccagctccgttgatgcgtggtcaccagtgaccagagaagctactcgatgcaatgcatctgtttcagatacagaaatatagagaagatatttattgaaatttaagttattgttatttattaccgttcactaatgaatttctcttttttcccttatttattaaagtttcttttcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattaattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcctgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcgaggctgcagtgagctgtgatcatgccactgcactccagcctaagtgacagtgcggtaccctgtctcaaaaaaaaaaaaaaaaaaaaaaagaggttggagcaggaggaagcataggggcgggaacagccacctcctccatgccctagattgtgaatttatcgggcagccaacacatgtatgacacactaggccctgtattacagcttgttacgcatttcataaaagggattttcattaaggagataatctattactacctaccttagtggctactagtataaaactatgacagatttagcaattaaatgaaatactggcctccatcaaataatcatagtaacaagaagcagcagttaccagacatctgatccccttcccccaaaatacccaaattcttcatggttctgcccttctctgtcctttctgctccccttgctcgcctgggaaatggaggaaaggccttccctctcacactgtcttgggatcttgctgagaattcagactgctcgaaacagtgacaaaccccagccatccagtcattcgtggagcacaatttggatgtggccccaggggcatctgtcccattcagagaaccttggcagtgcgatggccactgttcccaggcttcaacctcagtgaccccccccaacaactccccatggagagtccctgcccaaaaaagctgtaggatccaaggggtgtcaatagctcgttcccggcatcacctacacaccacaagcaggttttaatggaagcaagttgctccaccaaatccacaaaagggtaaagtttgtgatttttctttatcattgcgatcaccatctgataccgtaaggagtgcacttgtttggaagttctgacttctctgatctgtcttggtcgtttgtgttataaaaccaaagttctctacagactttatttttgtacaatatcattttgtaactttttacaaataaaaactcatttctattgc

SEQ ID NO: 386 - DNA, 3655 bp, Homo sapiens
catacaggccaaaagtctccaagtccctgctaacttcttgctctcgcaacagaatacctatttaggtgggaagaatgaggtgtgggcggcaggctgggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctgactccggctccagagactgctgtgtattgcattcctgctacagtgcaaagaaagggaccaaggttcccaggaaatgtttgcccagaatggaagatgaggaccaaggaggcggaggaggaggaagaagaagaggaggaggaggaggaggaggaggaggaggaggaaggcagccatcatgggagcctggtagagggagatccagctacagacaactggacaggagagagagaaaacagccctctggattctccaggatggcagccgatgtcactagaagctcagggctgatgttcctggttggctattgccaccatttcagctgatacagtccaccatcactgattaccggcgcggttgcggtggatgcacttgaaccaaaccagtgtatctcctgtgatttgttttcatgtgtccgaagacaccagggaaacagagatcctggtgttgttccttgttattacgttttactgctgaaagtaagaggtttatttttctgtcactcagtggagacataccctggaaaggagaggggaaaaaaaaagcaaagatacaagagataatcacctttgcatttgaaagttgaggcccgaggtttactacaaccagcatttttgccaacggttggtgattgatttccatcacggtgtgtggggtgggaagaagttggctaggaaccaaaaaggctgtgctcatgattaaacacaaacctgaaggtatttcctttatgtccttggaaacaggaaacgagttgtggttttcgccagcattcttgtaggagagaatcggggaaggccccgaactgcccccgggcagggagagcccctcaggcctgttggtttacagagagacagatgttacataaccagctccgttgatgcgtggtcaccagtgaccagagaagctactcgatgcaatgcatctgtttcagatacagaaatatagagaagatatttattgaaatttaagttattgttatttattaccgttcactaatgaatttctcttttttcccttatttattaaagtttcttttcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattaattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcctgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcgaggctgcagtgagctgtgatcatgccactgcactccagcctaagtgacagtgcggtaccctgtctcaaaaaaaaaaaaaaaaaaaaaaagaggttggagcaggaggaagcataggggcgggaacagccacctcctccatgccctagattgtgaatttatcgggcagccaacacatgtatgacacactaggccctgtattacagcttgttacgcatttcataaaagggattttcattaaggagataatctattactacctaccttagtggctactagtataaaactatgacagatttagcaattaaatgaaatactggcctccatcaaataatcatagtaacaagaagcagcagttaccagacatctgatccccttcccccaaaatacccaaattcttcatggttctgcccttctctgtcctttctgctccccttgctcgcctgggaaatggaggaaaggccttccctctcacactgtcttgggatcttgctgagaattcagactgctcgaaacagtgacaaaccccagccatccagtcattcgtggagcacaatttggatgtggccccaggggcatctgtcccattcagagaaccttggcagtgcgatggccactgttcccaggcttcaacctcagtgaccccccccaacaactccccatggagagtccctgcccaaaaaagctgtaggatccaaggggtgtcaatagctcgttcccggcatcacctacacaccacaagcaggttttaatggaagcaagttgctccaccaaatccacaaaagggtaaagtttgtgatttttctttatcattgcgatcaccatctgataccgtaaggagtgcacttgtttggaagttctgacttctctgatctgtcttggtcgtttgtgttataaaaccaaagttctctacagactttatttttgtacaatatcattttgtaactttttacaaataaaaactcatttctattgc

SEQ ID NO: 387 - DNA, 856 bp, Homo sapiens
ccaaagcgtccgagactgggtacagtcgtccaggcgtgacgggggcgcggggagccagtgactcctctgggaggggaagggattagggccagaatctctcaaaggtgcaaaaatccagtcaagagagggttttcgggtataccacggaggattaaaactttcaagacaaatgcagtctttgcctaacagcaatggtgccgccgccggacgggactttaagatgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 388 - DNA, 306 bp, Homo sapiens
catacaggccaaaagtctccaagtccctgctaacttcttgctctcgcaacagaatacctatttaggtgggaagaatgaggtgtgggcggcaggctgggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcct

SEQ ID NO: 389 - DNA, 295 bp, Homo sapiens
tggagaggggcgcagggacccgcagggagcccaggcttaacgtgcattctgcggttctctcccccacctcccgcctgcccgcgcaggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcct

SEQ ID NO: 390 - DNA, 764 bp, Homo sapiens
tggccgccgcctccagcgcgcccttgctgccccgcgcgaccccaggattgcgaactcttgcccctgacctgttgggcggggctccgcgctccagccatcagcccggatgggtctcctggctgggacttggggcacctggagttaatgtccaacctagggtctgcggagacccgatccgaggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 391 - DNA, 778 bp, Homo sapiens
ccaaagcgtccgagactgggtacagtcgtccaggcgtgacgggggcgcggggagccagtgactcctctgggaggggaagggattagggccagaatctctcaaaggtgcaaaaatccagtcaagagagggttttcgggtataccacggaggattaaaactttcaagacaaatgcagtctttgcctaacagcaatggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 392 - DNA, 799 bp, Homo sapiens
gcatagaatgcagatgagcaaagtgagtgggagagggaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataa

SEQ ID NO: 393 - DNA, 1280 bp, Homo sapiens
catagaatgcagatgagcaaagtgagtgggagagggaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 394 - DNA, 2968 bp, Homo sapiens
agggccccggaccgccgcggctcgcctcggcttgcctcgacacgcctaggcgccctccggctccgccctagccgccgcgtcccagctagagctccagcgcccgctcaggccccactccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaaattttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 395 - DNA, 3461 bp, Homo sapiens
aaacttaggagagtcctggttgtaagaggtattaacattttcagcagtagtactctagctacacttgactgttcccctctctgtgaatttacatgatatgtttgaaatactgcccctcaaaagtctcagaactttgagaaatacggtcctttccaaaaaaaccccttatgtccaatttgaaggggtcgctgtcagtgggtgcttaagtgggtaaagaaaagccaagaatatgtcagggtgaggaaggccaaggctgagcgaggtcagcttgggacccacctcctagaatgacctccgccagcaggaaaaaaccgttaaggggaggaaagggcaggtccctgcggcctccaggtgccagccgcgtgagtgggcggagaggcctcggtgcctcctacccgctccggacgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgacctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaaattttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaattgc

SEQ ID NO: 396 - DNA, 2010 bp, Homo sapiens
cgcggctcgcctcggcttgcctcgacacgcctaggcgccctccggctccgccctagccgccgcgtcccagctagagctccagcgcccgctcaggccccactcgacctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaagtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaaattttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatg

SEQ ID NO: 397 - DNA, 3096 bp, Homo sapiens
tagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcggtgcttgaatgtcattttgtggttgggattctgggctgtgcagctgaatgtctgtctgtcacgaatctaccttgctgctcattttcctcatcaagttgttgctggagtcctgtcaggcattgctgttgcagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcccattttgaggccagaggtgctgtcagctcaggtggtcctcttttacaatcctaatcatattgggtaatgtttttgaaaagctaatgaagctattgagaaagacctgttgctagaagttgggttgttctggattttcccctgaagacttacttattcttccgtcacatatacaaaagcaagacttccaggtagggccagctcacaagcccaggctggagatcctaactgagaattttctacctgtgttcattcttaccgagaaaaggagaaaggagctctgaatctgataggaaaagaaggctgcctaaggaggagtttttagtatgtggcgtatcatgcaagtgctatgccaagccatgtctaaatggctttaattatatagtaatgcactctcagtaatgggggaccagcttaagtataattaatagatggttagtggggtaattctgcttctagtattttttttactgtgcatacatgttcatcgtatttccttggatttctgaatggctgcagtgacccagatattgcactaggtcaaaacattcaggtatagctgacatctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacatcttctctctttttttttttttttgagacagggtctcactatgttgcccaggctgctcttgaattcctgggctcaagcagtcctcccaccctaccacagcgtcccgcgtagctgggactacaggtgcaagccactatgtccagctagccaactcctccttgcctgcttttctttttttttctttttttgagacggcgcacctatcacccaggctggagtggagtggcacgatcttggctcactgcaacctcttcctcctggttcaagcgattctcatgtctcagcctcctcagtagctaggactaccggcgtgcaccaccatgccaggctaatttttatatttttagaattttagaagagatgggatttcatcatgttggccaggctggtctcgaactcctgacctcaagtgatccacctgccttggcctcccaaggtgctaggattacaggcatgagccaccgcaccgggccctccttgcctgtttttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatc

SEQ ID NO: 398 - DNA, 3774 bp, Homo sapiens
acccgcctctgcgcgcccccgggcacgaccccggagtctccgcgggcggccagggcgcgcgtgcgcggaggtgagccgggccggggctgcggggcttccctgagcgcgggccgggtcggtggggcggtcggctgcccgcgcggcctctcagttgggaaagctgaggttgtcgccggggccgcgggtggaggtcggggatgaggcagcaggtaggacagtgacctcggtgacgcgaaggaccccggccacctctaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccagtggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaatc

SEQ ID NO: 399 - DNA, 3589 bp, Homo sapiens
acccgcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccagtggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaatc

SEQ ID NO: 400 - DNA, 2387 bp, Homo sapiens
tccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 401 - DNA, 2276 bp, Homo sapiens
gctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 402 - DNA, 1739 bp, Homo sapiens
acttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcat

SEQ ID NO: 403 - DNA, 2174 bp, Homo sapiens
acatgacccatccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 404 - DNA, 2400 bp, Homo sapiens
ctctctctctctcgctcgctctctcgctctctcgctctctctcgctcgctctctcgctctcgctctctctctctctccggctcgccagcgacacttgttcgttcaacttgaccaatgagacttgaggaagggctctgagtcccgcctctgcatgagtgaccgtctcttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 405 - DNA, 1790 bp, Homo sapiens
attacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagagcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccct

SEQ ID NO: 406 - DNA, 1652 bp, Homo sapiens
agtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttgg

SEQ ID NO: 407 - DNA, 3132 bp, Homo sapiens
agatactgacagggcagataccgtcctcacaatacctgcccagaaagacgagaaagaggaggaagaattcctccttccaccaggaattctgtgggaagcacataagatttcatgctactagtttattcccaagagaagctaccaaagcctggtaactctaccaactctaacttttgtgcctgtaagttctcttctcctgggattacaactaattgaaacaggaattcaaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctgatgtagttactccaaacggcttgaatgttaagaaattttcagcagtgcatgagtttcaaaatctacatgccatgtacaaggccagaatccaagattttgttcgaggtcatttctatggtcatctcgactttgatcttgaaaagactttgttccttttcattgctgggaggtatgagttttcaaacaaaggagctgacatcttcctagaatccttatccaggctaaatttcctgctgaggatgcataaaagtgacatcacagtgatggtgtttttcattatgcctgccaagacaaataatttcaacgtggaaaccctgaaaggacaagcagtgcgaaaacagctgtgggatgttgcacattctgtgaaggaaaagtttggaaaaaaactctatgatgcattattaagaggagaaattcctgacctgaacgatattttagatcgagatgatctaacaattatgaaaagagccatcttttcaactcagcgacagtcattgcccccagtgaccacgcacaacatgattgatgactccaccgaccccatcctcagcaccattagacggattggacttttcaacaaccgcacagatagagtcaaggtgattttgcacccagagtttctatcctccaccagtcccttactacccatggactatgaagagtttgttagaggttgtcatcttggagtatttccatcatactatgaaccctggggttatactccagctgaatgcactgtgatgggtatccccagtgtgaccacgaatctctccgggtttggctgtttcatgcaggagcacgtggctgatcctactgcttacggtatttacatcgttgacaggcggttccgttctccagatgattcttgcaatcagctgactaagtttctctatggattttgcaaacagtcacgccgccaaaggattatccagaggaacagaactgagaggctctcagatcttctggattggagatacttaggcagatattaccagcatgccagacacctgacattaagcagagcttttccagataaattccatgtggaactaacatcaccaccaacgacagaaggatttaaatatcccaggccttcctcagtaccaccttctccttcagggtctcaggcctccagtcctcagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactgaattctacatgtgctgcatgaagagctaatttaaaaaagcaaagtaagactaattatttaaaataaaaatgccacaaatttcattttctccttctaagtattacaatggagtttattctctgcctaaaaagtggaagaaattgagtgaatgacaattttgtaatttaggataagatccaagttattttccccaactcttgtttcccccataaagttaggcatgaggaggagcactcattaaaggcagaagacggaaaagtgtttttaaaatggtgaatttaagtggtaaggattttctcttactctgtttatttttaaatgatcatcataatcctttgcttactatttatgcagcttctctaccccaccacacaaatttcccatttcccccccgaaaaccttgatcttacccatgaatgtgcactacctacattttttaaatagctaggtttttactgattattttcatttttcacatgcatcagaaccatgatttagatgtagttttgcagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaa

SEQ ID NO: 408 - DNA, 710 bp, Homo sapiens
gcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 409 - DNA, 803 bp, Homo sapiens
ccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 410 - DNA, 537 bp, Homo sapiens
aggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 411 - DNA, 702 bp, Homo sapiens
aggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 412 - DNA, 756 bp, Homo sapiens
ccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 413 - DNA, 1138 bp, Homo sapiens
gagaaacaggtgaggagaagcagcgagagagaaggggccaggtataaaaagggcccacaagagaccagctcaaggatcccaaggcccaactccccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttgaagaagcctatatcctgaaggagcagaagtattcattcctgcagaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtgggtgagggtggcaccagggatccccaatcctggggccccactggcttccagggactggggagagaaacactgctgccctctttttagcagtcaggcgctgacccaagagaactcaccgtattcttcatttcccctcgtgaatcctccaggcctttctctacaacctggaggggagggaggaaaatggatgaatgagagagggagggaacagtgcccaagcgcttggcctctccttctcttccttcactttgcagaggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaa

SEQ ID NO: 414 - DNA, 819 bp, Homo sapiens
aggatcccaaggcccaactccccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttgaagaagcctatatcctgaaggagcagaagtattcattcctgcagaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtggaggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaagttgca

SEQ ID NO: 415 - DNA, 753 bp, Homo sapiens
ccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtggaggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaagttgca

SEQ ID NO: 416 - DNA, 794 bp, Homo sapiens
ccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttgaagaagcctatatcctgaaggagcagaagtattcattcctgcagaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgataggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaagttgca

SEQ ID NO: 417 - DNA, 1977 bp, Homo sapiens
cctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttgttcttgtg

SEQ ID NO: 418 - DNA, 846 bp, Homo sapiens
cgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgaagtcaaataaatataataaagggttgagctactttcttcttgccacctttttgtggcaatattaa

SEQ ID NO: 419 - DNA, 2943 bp, Homo sapiens
aaaaaggaggcgcggccgggctttccagcctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttg

SEQ ID NO: 420 - DNA, 1805 bp, Homo sapiens
cgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaac

SEQ ID NO: 421 - DNA, 1897 bp, Homo sapiens
ctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgaagtcaaataaatataataaagggttgagccctctactttcttcttgccacctttttgtggcaatattaaagtgaactgctaatagtgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttg

SEQ ID NO: 422 - DNA, 1158 bp, Homo sapiens
aaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttg

SEQ ID NO: 423 - DNA, 1922 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcac

SEQ ID NO: 424 - DNA, 804 bp, Homo sapiens
aagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaagga

SEQ ID NO: 425 - DNA, 1704 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatg

SEQ ID NO: 426 - DNA, 653 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctaga

SEQ ID NO: 427 - DNA, 809 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgctgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttc

SEQ ID NO: 428 - DNA, 5286 bp, Homo sapiens
ttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcactttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtcttttttttttttttgagactctattgcccaggctggagtgcaatggcatgatctcggctcactgtaacctctgcctcccaggttcaagcgattctcctgtctcagcctcccaagtagctgggattacaggcgtgcaccaccatgcccggctaatttttgtatttttagtagagacagggtttcaccatgttggccaggctggtctcgaactctcctgacctcgtgatccgcctgcctcggcctcccaaagtgctgagattacaggtgtgagccaccctgcccagccgtcaaaagagtcttaatatatatatccagatggcatgtgtttactttatgttactacatgcacttggctgcataaatgtggtacaagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtatattgtattgtatactgcatgattttattgaagttcttgttcatcttgtgtatatacttaatcgctttgtcattttggagacatttattttgcttctaatttctttacattttgtcttacggaatattttcattcaactgtggtagccgaattaatcgtgtttcttcactctagggacattgtcgtctaagttgtaagacattggttattttaccagcaaaccattctgaaagcatatgacaaattatttctctcttaatatcttactatactgaaagcagactgctataaggcttcacttactcttctacctcataaggaatatgttacaattaatttattaggtaagcatttgttttatattggttttatttcacctgggctgagatttcaagaaacaccccagtcttcacagtaacacatttcactaacacatttactaaacatcagcaactgtggcctgttaatttttttaatagaaattttaagtcctcattttctttcggtgttttttaagcttaatttttctggctttattcataaattcttaaggtcaactacatttgaaaaatcaaagacctgcattttaaattcttattcacctctggcaaaaccattcacaaaccatggtagtaaagagaagggtgacacctggtggccataggtaaatgtaccacggtggtccggtgaccagagatgcagcgctgagggttttcctgaaggtaaaggaataaagaatgggtggaggggcgtgcactggaaatcacttgtagagaaaagcccctgaaaatttgagaaaacaaacaagaaactacttaccagctatttgaattgctggaatcacaggccattgctgagctgcctgaactgggaacacaacagaaggaaaacaaaccactctgataatcattgagtcaagtacagcaggtgattgaggactgctgagaggtacaggccaaaattcttatgttgtattataataatgtcatcttataatactgtcagtattttataaaacattcttcacaaactcacacacatttaaaaacaaaacactgtctctaaaatccccaaatttttcataaactcagttttaaactaactttttttcaaaccacaatctgatttaacaatgactatcatttaaatatttctgactttcaaattaaagattttcacatgcaggctgatatttgtaattgtgattctctctgtaggctttgggtataatgtgttcttttccttttttgcatcagcgattaacttctacactctaacatgtagaatgttactacaatattaaagtattttgtatgacaattttatttgaaagcctaggatgcgttgacatcctgcatgcatttattacttgatatgcatgcattctggtatctcaagcattctatttctgagtaattgtttaaggtgtagaagagatagatatggtggatttggagttgatacttatatattttctatttcttggatggatgaatttgtacattaaaagttttccatggcagaaa

SEQ ID NO: 429 - DNA, 1280 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttc

SEQ ID NO: 430 - DNA, 1045 bp, Homo sapiens
gagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacg

SEQ ID NO: 431 - DNA, 1123 bp, Homo sapiens
cccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagaaggaagtgaaagttccagtcttcctggcaaggtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaa

SEQ ID NO: 432 - DNA, 781 bp, Homo sapiens
gagatttaacggggacgtgcggccagagctggggaaatgggcccgcgagccaggccggcgcttctcctcctgatgcttttgcagaccgcggtcctgcaggggcgcttgctgcagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacg

SEQ ID NO: 433 - DNA, 646 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggtgcttcaggataccatatacagctcagaagtttcttctttaggcattaaattttag

SEQ ID NO: 434 - DNA, 841 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgagccaccctgcccagccgtcaaaagagtcttaa

SEQ ID NO: 435 - DNA, 2128 bp, Homo sapiens
cttctctggttccctgacctcagtgagacagcagccggcctggggacctgggggagacacggaggaccccctggctggagctgacccacagagtagggaatcatggctggagaattggatagcagagtaatgtttgacctctggaaacatcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatgctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatc

SEQ ID NO: 436 - DNA, 2123 bp, Homo sapiens
atattctttctaatcctctaaccctccccactcccccaactcccacaccctacccccaccaacgttcctggaattttggacttagctatttttaaaaccgtcaactcagtagccacctccctccctgctcagctgtccagtactctggccagccatatactcccccttccccccataccaaaccttctctggttccctgacctcagtgagacagcagccggcctggggacctgggggagacacggaggaccccctggctggagctgacccacagagtagggaatcatggctggagaattggatagcagagtaatgtttgacctctggaaacactcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacacca

SEQ ID NO: 437 - DNA, 536 bp, Homo sapiens
cttctctggttccctgacctcagtgagacagcagccggcctggggacctgggggagacacggaggaccccctggctggagctgacccacagagtagggaatcatggctggagaattggatagcagagtaatgtttgacctctggaaacaccaaatttcttttttcagtcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatgctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccg

SEQ ID NO: 438 - DNA, 1381 bp, Homo sapiens
ttctctggttccctgacctcagtgagacagcagccggcctggggacctgggggagacacggaggaccccctggctggagctgacccacagagtagggaatcatggctggagaattggatagcagagtaatgtttgacctctggaaacactcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatc

SEQ ID NO: 439 - DNA, 1419 bp, Homo sapiens
cttctctggttccctgacctcagtgagacagcagccggcctggggacctgggggagacacggaggaccccctggctggagctgacccacagagtagggaatcatggctggagaattggatagcagagtaatgtttgacctctggaaacactcattctcaatgcaagatcctccgctgcaatgctgactcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatc

SEQ ID NO: 440 - DNA, 1381 bp, Homo sapiens; identical to SEQ ID NO: 438

SEQ ID NO: 441 - DNA, 1419 bp, Homo sapiens; identical to SEQ ID NO: 439

SEQ ID NO: 442 - DNA, 5989 bp, Homo sapiens
gaggaaaggagggggctggaagagagtaaagggctgttgttaaacagtttcttaccgtaagagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtgcatgcactacagtttaaattatggtgtacctaatgtaacccctaaatattttagaagtatgtacctatagttttacctcaaaaaaaccagaaatctctaaagaccagtagaaatattaaaaaatgatgcaagatcaaaatgattagctaattctccatacataatctgcagatgatcttctttggttggcatttcaggtgtggccatcacccagagttaaataacacctaatctaggtgtttacatgtattcattatcctagttatttcatgtagtttctaattcttaaaggaaagagggtaatagttctatttgtgtaatttgtttcctccaaacttaaggccacttatttacacaagatatttgtagatctattttcctaaagcatttcttaagtgctcagatcagtatctaattgaagaagtttaaaagtgttttggtcattaaaaatgtacttaaataggttaaatctaagccttgctgctgtgattggcttctagctcactgcctttaaattttaaaaaatttaagaggaaaatttccaagtctccaaagttttataaatacccttcatcaagtcatgcattaaagtatatattggagaaaaaaataaaaatacttttctcaacctggaagattttagcctaataaagcttttttgaagtaaaagacaacttgtaaaaggaaagaaactagtttgtctcaactctgtattcatttattttttttttgaagtagagtggaatctgttgaatcagatattttatcaagatatgtttattttttcttatttcattttacaaagttcactcctaatgccatatgtaacagacatttaaattttgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatacagctaagtatttagacattttgaggctagtatttttcattttattaaaggctaaaaacaataccaccaataaatcatcaaacaaaccgtacaaagtaattctctctttgggaggctcctttcgtgatagagggacatgggtggaattgacaatgaaacttagatgaacaaggtccatgttattttaggtggtagaacagggtagagtcatgtcattatttgctggtggaagacactatttaccaggtgttctttgctgaataaatcattaaacatttttaaaaatccaacaatccactttattttgtgtcattgacaaaaggatcttttaaatcagaaggtttcaatgcaatttttggtttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaattaataagctgcctattgagtggtatagctgtatgcttacccaaaaaagggaacactgtggttatgacttgtattataaactttctgtagttaataaagttgttatttttataaccatgattatattattattattaataaaatattttatcaaaatgct

SEQ ID NO: 443 - DNA, 1425 bp, Homo sapiens
atgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagtggtggtgatgactgccttgttgaatccactttttattctattccattttggggacacaattctgcaagatgattcttcattaggaaacagagatgagttattgaccaacacagaaagaaaaagagtttgttgctccacactgggattaaacctatgatcttggcctaattaacactagctagtaagtgtccaagctgatcatctctacaacatttcaataacagaaaacaacaattttcaaaattagttacttacaattatgtagaaatgcctctaaaacacagtattttccttatattacaaaaacaaaaattataattggttttgtcctcttttgagagtttgcatggtgttactccctgcatagtgaagaaaacattttatttaagtagatggatctaagtttttcatgaacaaaggaatgacatttgaaatcaatcctaccctagtccaggagaatgcattagattaacctagtagaggtcttatttcaccctgagttttctatgatcgtgattctctgctggaggagtaattgtgaaatagatctctctgggaactggcttcctagtccaatcagctcttttaccaatgaacacttccttgtgatatagatgtttatggccgagaggatccagtatattaataaaatccctttttgtattcaatgagggaaacacataattttcatcaattagcagcttattggaatatctgcatgatggtttaacacttttaagtgttgactaaagattaattttacagaaaatagaaaaagaaatatgtttctgtctggaggaatgatttattgttgacccctaaattgaaatattttactagtggcttaatggaaagatgatgaaagatgatgaaattaatgtagaagcttaactagaaaatcaggtgacctgatatctacatctgtatccttcattggccacc

SEQ ID NO: 444 - DNA, 1053 bp, Homo sapiens
agttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcggagacataacatgggctctcaactga

SEQ ID NO: 445 - DNA, 590 bp, Homo sapiens
attgggctcagccttgctcctcccttccttactcggataggagccactgggatctggagctccagcttccaaattgaagctggcctcaggccaggtgaccttttctttgattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctat

SEQ ID NO: 446 - DNA, 545 bp, Homo sapiens
attgagcgaattggtcccctgcctgtgccttgatttagccattgggctcagccttgctcctcccttccttactcggataggagccactgggatctggagctccagcttccaaattgaagctggcctcaggccaggtgaccttttctttgcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctct

SEQ ID NO: 447 - DNA, 1990 bp, Homo sapiens
cacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaaggtaaataaacctgaatgccatgtgggccattctattccccctatgtgtagaactgtaactcacattaaaggttaacagcaacgaatcaatcataacaaatatgttgttcgtgcaaatgcaactacaaataattatttaaacatttttatacaatgtttttaaaactgttggattatcaccagattaatgcaaaataacagagcgagttatcagtttgaatttcaacactgcctgagacatccctctggggaaagtgaaagagagggtttacttacctactgtcttgagctcacatacctcaaaatctactactgtgtggcacctgaaaggagttgaatgaagcttagcctttcattagcaatgttaattctattcaaccagcacctgcttccacagaaattctgtccaaactatcatgaagtggtgtgacaagggtatatggacccagaagataatacaatataagaagggatcactggaagcttgaccccatgcacattttggtgaaaatgtgcctagaatcaaatgtgacacgtaggctggaactgagtaccattcagaataggatctgaagagatcaaagcaatggagaccaccaaactgtcttgaaggcatgtctatggaccttaagtccatgtctatgttttcagctcttctcacagcataaaagggcattgtccttacttttgcagtggaaaactgaatggctgacaagatggaagagtaaccatttcagcattgtatgtggtttcatttttcttagttatctggctactgaatagccggatttttcagttctgtcagaaactctaaatttccaaaaatctaagtgaaacatggatgaaactctgttagaaaattgttaggattttggagtatttggggagggggactactggaatgctgtccaagttttatactaagatatcttacctgtttgttattaaccaaatatttttaaaaatatttcctccataaatattcatttaatattaggttgatatttatcacataaaaagtaaaggctactgttagctaattgtcacagagaaggatttgttttctgttgttagtgaatttgaaatccttgactttatgtgctacagccagttccatctctgtttgtaaattcttactttccattccatatcatattctgttccctataacctcttcattgttttcttttcttttaaaaataataaacttttctatgatcacgttttgaaca

SEQ ID NO: 448 - DNA, 1184 bp, Homo sapiens
caggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctttatagctgatccctacctctctcgctgtctttgtacccagcctgcattctgtttcgatctgtcttttagcagtccatacaatcatttttctacatgctggcccttacctagcttttctgaatttacaataaaaactattttttaacgtg

SEQ ID NO: 449 - DNA, 1111 bp, Homo sapiens
ggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctttatagctgatccctacctctctcgctgtctttgtacccagcctgcattctgtttcgatctgtcttttagcagtccatacaatcatttttctacatgctggcccttacc

SEQ ID NO: 450 - DNA, 2249 bp, Homo sapiens
taggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatag

SEQ ID NO: 451 - DNA, 424 bp, Homo sapiens
gactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttcc

SEQ ID NO: 452 - DNA, 652 bp, Homo sapiens
gagcctcccacgtggtgtggatgaggaggcagatggcagggcctgtgcatttctgtgcttgagtgggccttgaaagtggttcagcaaccaggaagaagtgttcattcctcgacaacaacatccccgggctctggtgacttggctgacactggatggccctggaatgaaaaaggcaaagaggcaaaatgtgcaagggcccatctggaaccaaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaa

SEQ ID NO: 453 - DNA, 1407 bp, Homo sapiens
ctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaa

SEQ ID NO: 454 - DNA, 804 bp, Homo sapiens
agcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagtctaggttgttggcagaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaa

SEQ ID NO: 455 - DNA, 7619 bp, Homo sapiens
gccccggaggggagggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgcattgtttggggtttggttttatgcttactgtgtctctccaccccattatcagagtaatatatgctcattgcataaaatctggaacatgtgaaaactggagatgaaaagaagcccagcatttgagacatacccactgctgacatttgtatatttcctttcattcttttacctgcctaaagacatatatgcagatatggacatatttagctttacatacatgcagactaccacatataatctatatcttgtttttttgatctaacacaatgttagcttggttttttatgtcattgacagttcttgattaacagctgtaatggctgcacagccctgcttcattaatttttttttttggactgaaatgtatgtaccacgttccgcttatccattcatccaccagtgaccacttgggtcatttctaccttttggccattgcaataatgttgctgtcaacaaggatgtacaaatatctgttcgagtccctgctcttaattgttttgggtatacacccaacctacattaatctttaatcacttaagatgttggggtttgtgctgggaggtaaccaagtgactctggagcagcctcaccctagctacagagggaaactgactcttccctctctgcccaatcttttgccgcctgtcaggttcccaagctgtccataccttactgtgtgaagcgctttgggtataaactcccaaatagaggctcagccccttttcctttcccaagtccatcctgcaggttatagctcttcagaggaatctcttgaattctggcctgggatctgggattaaagtagaacccagggtgtcccttggggccttaggcatagcccgttgtggtggaacctgccatcagccccactgcactcagtggtcccctggtacttcaggacagtttctctcttctgcacatgagaacttcaagcagagaggactgtcagttgttgccttcacatcaccaatcgtttggccataatggccaagagccctcactgctcttgggtcttgcctttccacatgttactgaaagctcccgttggtgtccctgtccactaactcacctgatgggacagatgccactttcctctgagtgtctgataaaacacagtctgttgtggggagcccacgctcaagggttttctttgggatcagagtttcccggctattactccatgccctgcctgacatcactgtcatgtatggtgctaatcaccaaaggatgcccttgtttgattctggattctaggtgatagtccttatcctctgatgggggaagagtttgggtgggagagaacaaaccgacaagttggttccagatgaggtggctgggagccaaccctcaggtacttggctctgagtaatgtgacggcccaggcaagagggctcccactgccaatgaggaacaaaagctcaaggtctagtagtgtattcagcacatgctaggaaacaagagttgggacgtggacaaggagaggagcaaaggccaggggttaactgcttttggtttttcctctataaaagtcagggactatgatttatatgggtgagaaggtttggagtaggactgaagctgccatttacaaaccccttgccctaatttattgtagttttgggtgtgtttctgaaagaaccttttgcaggtgatttttattcagtactcattaacttacagcttttatgaattcacatcttctacactattgaaaaacataagtttgtattgtgttaagtgcagcatgagttattatatgaataaatcacattaaatttgc

SEQ ID NO: 456 - DNA, 1399 bp, Homo sapiens
gccccggaggggagggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgattattca

SEQ ID NO: 457 - DNA, 1156 bp, Homo sapiens
agaacccgccccggaggggagggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcaggaggaccaaagttccacaggtttcagactgaagacttcatctaccagaaagtataagtag

SEQ ID NO: 458 - DNA, 1213 bp, Homo sapiens
ctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccatgtccagagtctgggttctcttggtttgtggtgtctgaatccagcattcccatcctggggatggggctgtctttgcagagccctcttctggctgggcgagtccctcgctagtcagtgcttcctttctaaaaaactgacttgtcaacccagccacgttttcacccaaagtgaaaaagggtagaaagagctttgcttcctttcagaaaccactgagggtgtgctgttgggtctttcagctcctcgggtggtagggaggacacaggctggggaggtggcagtgttgggtggagtccagctcagggccccaccctctcccctgcagggtacctgtcagtaaacctaggggtggggtgaggacacctgagggcctcccgtgtggccagcattgctgttgctgacttattgcccaatgagggggctgtgcttaggtaggggctgctatccactctggaaattaagtcagaaagatgagtgtaatctggtacccaggatctatagggtcccagagacggacattccttacctcaaatgctgcctgataaactggctctctttaatgccaatatggggatagtgaaaagcaaacaaactttaaaactttttatttatagaagtaatgcatgagtatttgagaaaaaaaa

SEQ ID NO: 459 - DNA, 572 bp, Homo sapiens
agcattttatcatgtttgttggcgcttgtatgtcgtcttttgagaagcgtctgttcatgtcctttgcctggtttttaatggggttgtttttagcttgttgattttagttccttgtagattctggatattagacatttttggatgcatactttccttgacctcatgaggacacccttcccaggacaggggggacatctgctgcttcccaaatgccacatttcttcaaataaaaagcagaagacagcatgcagtacataaggaactcatgtcttgcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccga

SEQ ID NO: 460 - DNA, 1032 bp, Homo sapiens
ctggccaacagcaccatcattgcatttacctcggatcatggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttc

SEQ ID NO: 461 - DNA, 2635 bp, Homo sapiens
ttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcttccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgctcagaaaaggtgccctggagaatgggtgcgtgctgaacacaatagggaagggcccagcatctgccttggcataggcagaactgtgctgtgccctgcaacaggccacctgagagctgctttgatcttgtgtgtacattagacgactgccaggggcatgaaggggatgtgcttccagggcatttgctggcagggcgtcttgtgatttcttggtattggtgtgagcatagcctggcaggagagggcagatctccgtgcaaagtatgtcagaaagcagatggaagccaggccccctcctgaaagaggctccttgaagataattctaacatctttgtcatcagtgttgacatctcttgattgtatcctgtcattccatttgagatcttcctggttctggctggcatcctctgacatcactccagcagaagaaagggaaggaacacgctgcattactgcgtgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggt

SEQ ID NO: 462 - DNA, 2163 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcatgtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatatttta

SEQ ID NO: 463 - DNA, 2251 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcatgtggacgcggcccgcgcgctgtggcccctgcggcgcttctggaggagcacaggcttctgggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaaggtgcgccctgcccctccgtccgccccggtgttctgcgccctcagccgctgtgccccgggccgcgctgaccctggtggtgctgaggcggccccgcccgcagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtgggccggcccaacgccctgcgcgccccccggccaccttcctcccgagacgggacaggcgagcggtggccgcgccacccggtcccagctgccctggacacccgcaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggt

SEQ ID NO: 464 - DNA, 828 bp, Homo sapiens
agccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagggcctgcagggagggatccagcaggtgactcttcaggctgatttgcccatcccagatagaagccgggagtgttctttcaaaggtgtctttaccttagacactcaataaaatggtaacaca

SEQ ID NO: 465 - DNA, 503 bp, Homo sapiens
ccagcagccctcagccctccaggacaggctgcatcagaagaggccatcaagcaggtctgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 466 - DNA, 597 bp, Homo sapiens
aaattgcagcctcagcccccagccatctgccgacccccccaccccaggccctaatgggccaggcggcaggggttgagaggtaggggagatgggctctgagactataaagccagcgggggcccagcagccctcagccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 467 - DNA, 639 bp, Homo sapiens
tccaggacaggctgcatcagaagaggccatcaagcaggtctgttccaagggcctttgcgtcaggtgggctcaggattccagggtggctggaccccaggccccagctctgcagcagggaggacgtggctgggctcgtgaagcatgtgggggtgagcccaggggccccaaggcagggcacctggccttcagcctgcctcagccctgcctgtctcccagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 468 - DNA, 297 bp, Homo sapiens
atggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcagggcagcctgcagcccttggccctggaggggtccctgcagaagcgtggcattgtggaacaatgctgtaccagcatctgctccctctaccagctggagaactactgcaactag

SEQ ID NO: 469 - DNA, 963 bp, Homo sapiens
caaggttatccatctcaagtagcctagcaatatttgcaacatcccaatggccctgtccttttctttacttatggccgtgctggtgctcagctacaaatccatctgttctctaggctgtgatctgcctcagacccacagcctgggtaataggagggccttgatactcctgggacaaatgggaagaatctctcctttctcctgcctgaaggacagacatgatttccgaatcccccaggaggagtttgatggcaaccagttccagaaggctcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggactccatcctggctgtgaggaaatacttccaaagaatcactctttatctaatagagaggaaatacagcccttgtgcctgggaggttgtcagagcagaaatcatgagatccctctcgttttcaacaaacttgcaaaaaagattaaggaggaaggattgaaaactggttcaacatggcaatgatcctgattgactaatacattatctcacactttcatgagttcttccatttcaaagactcacttctataaccacgacgcgttgaatcaaaattttcaaatgttttcagcagtgtaaagaagtgtcgtgtatacctgtgcaggcactagtcctttacagatgaccattctgatgtctctgttcatcttttgtttaaatatttatttaattatttttaaaatttatgtaatatcatgagtcgctttacattgtggttaatgtaacaatatatgttcttcatatttagccaatatattaatttcctttttcattaaatttttactatac

SEQ ID NO: 470 - DNA, 705 bp, Homo sapiens
agagaacctagagcccaaggttcagagtcacccatctcagcaagcccagaagcatctgcaatatctatgatggcctcgccctttgctttactgatggccctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacacctggtccaacatgaaacaattcttattgactcatataccaggtcacgctttcatgaattctgc

SEQ ID NO: 471 - DNA, 778 bp, Homo sapiens
gttacccctcatcaaccagcccagcagcatcttcgggattcccaatggcattgccctttgctttaatgatggccctggtggtgctcagctgcaagtcaagctgctctctgggctgtaatctgtctcaaacccacagcctgaataacaggaggactttgatgctcatggcacaaatgaggagaatctctcctttctcctgcctgaaggacagacatgactttgaatttccccaggaggaatttgatggcaaccagttccagaaagctcaagccatctctgtcctccatgagatgatgcagcagaccttcaatctcttcagcacaaagaactcatctgctgcttgggatgagaccctcctagaaaaattctacattgaacttttccagcaaatgaatgacctggaagcctgtgtgatacaggaggttggggtggaagagactcccctgatgaatgaggactccatcctggctgtgaagaaatacttccaaagaatcactctttatctgatggagaagaaatacagcccttgtgcctgggaggttgtcagagcagaaatcatgagatccctctctttttcaacaaacttgcaaaaaagattaaggaggaaggattgaaaactggttcatcatggaaatgattctcattgactaatacatcatctcacactttcatgagttcttccatttcaaagactcacttctcctataaccaccacaagttgaatcaaaattttcaaatgttttcaggagtgtaaagaagcatcatgtatacctgtgca

SEQ ID NO: 472 - DNA, 939 bp, Homo sapiens
atcccaatggccctgtccttttctttactgatggccgtgctggtgctcagctacaaatccatctgttctctgggctgtgatctgcctcagactcacagcctgggtaataggagggccttgatactcctggcacaaatgggaagaatctctcatttctcctgcctgaaggacagatatgatttcggattcccccaggaggtgtttgatggcaaccagttccagaaggctcaagccatctctgccttccatgagatgatccagcagaccttcaatctcttcagcacaaaggattcatctgctgcttgggatgagaccctcctagacaaattctacattgaacttttccagcaactgaatgacctagaagcctgtgtgacacaggaggttggggtggaagagattgccctgatgaatgaggactccatcctggctgtgaggaaatactttcaaagaatcactctttatctgatggggaagaaatacagcccttgtgcctgggaggttgtcagagcagaaatcatgagatccttctctttttcaacaaacttgcaaaaaggattaagaaggaaggattgaaaactcattcaacatggaaatgatcctcattgattaatacatcatctcacactttcatgagttcttccatttcaaagactcacttctataaccaccacaagttgaatcaaaattttcaaatgttttcaggagtgtaaagaagcatcgtgtttacctgtgcaggcactagtcctttacagatgaccatgctgatgtctctattcatctatttatttaaatatttatttatttaactatttttaaggtttaaatcatgttttatgtaatatcatgtgtacctttacattttgcttaatgtaacaatatatgttcttcatatttagttaatatattaacttccttttcattaaatttttactatac

SEQ ID NO: 473 - DNA, 980 bp, Homo sapiens
gttcaaggttacccatctcaagtagcctagcaacatttgcaacatcccaatggccctgtccttttctttactgatggccgtgctggtgctcagctacaaatccatctgttctctaggctgtgatctgcctcagacccacagcctgggtaataggagggccttgatactcctggcacaaatgggaagaatctctcctttctcctgcctgaaggacagacatgactttggacttccccaggaggagtttgatggcaaccagttccagaagactcaagccatctctgtcctccatgagatgatccagcagaccttcaatctcttcagcacagaggactcatctgctgcttgggaacagagcctcctagaaaaattttccactgaactttaccagcaactgaataacctggaagcatgtgtgatacaggaggttgggatggaagagactcccctgatgaatgaggactccatcctggctgtgaggaaatacttccaaagaatcactctttatctaacagagaagaaatacagcccttgtgcctgggaggttgtcagagcagaaatcatgagatctctctctttttcaacaaacttgcaaaaaatattaaggaggaaggattgaaaactggttcaacatggcaatgatcctgattgactaatacattatctcacactttcatgagttcctccatttcaaagactcacttctataaccaccacgagttgaatcaaaattttcaaatgttttcagcagtgtaaagaagcgtcgtgtatacctgtgcaggcactagtactttacagatgaccatgctgatgtctctgttcatctatttatttaaatatttatttaattatttttaagatttaaattatttttttatgtaatatcatgtgtacctttacattgtggtgaatgtaacaatatatgttcttcatatttagccaatatattaatttcctttttcattaaatttttactatac

SEQ ID NO: 474 - DNA, 1143 bp, Homo sapiens
gagaacctggagcctaaggtttaggctcacccatttcaaccagtctagcagcatctgcaacatctacaatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgaaaactggttcaacatggaaatgattttcattgattcgtatgccagctcacctttttatgatctgccatttcaaagactcatgtttctgctatgaccatgacacgatttaaatcttttcaaatgtttttaggagtattaatcaacattgtattcagctcttaaggcactagtcccttacagaggaccatgctgactgatccattatctatttaaatatttttaaaatattatttatttaactatttataaaacaacttatttttgttcatattatgtcatgtgcacctttgcacagtggttaatgtaataaaatatgttctttgtatttggtaaatttattttgtgttgttcattgaacttttgctatggaaacttttgtacttgtttattctttaaaatgaaattccaagcctaattgtgcaacctgattacagaataactggtacacttcatttatccatcaatattatattcaagatataagtaaaaataaactttctgtaaacca

SEQ ID NO: 475 - DNA, 1024 bp, Homo sapiens
ttcaaggttacccatctcaagtagcctagcaatattggcaacatcccaatggccctgtccttttctttactgatggccgtgctggtgctcagctacaaatccatctgttctctgggctgtgatctgcctcagacccacagcctgggtaataggagggccttgatactcctggcacaaatgggaagaatctctcctttctcctgcctgaaggacagacatgactttggattcccccaggaggagtttgatggcaaccagttccagaaggctcaagccatctctgtcctccatgagatgatccagcagaccttcaatctcttcagcacaaaggactcatctgctacttgggaacagagcctcctagaaaaattttccactgaacttaaccagcagctgaatgacctggaagcctgcgtgatacaggaggttggggtggaagagactcccctgatgaatgtggactccatcctggctgtgaagaaatacttccaaagaatcactctttatctgacagagaagaaatacagcccttgtgcctgggaggttgtcagagcagaaatcatgagatccttctctttatcaaaaatttttcaagaaagattaaggaggaaggaatgaaacctgtttcaacatggaaatgatctgtattgactaatacaccagtccacacttctatgacttctgccatttcaaagactcatttctcctataaccaccgcatgagttgaatcaaaattttcagatcttttcaggagtgtaaggaaacatcatgtttacctgtgcaggcactagtcctttacagatgaccatgctgatagatctaattatctatctattgaaatatttatttatttattagatttaaattatttttgtccatgtaatattatgtgtacttttacattgtgttatatcaaaatatgttatttatatttagtcaatatattattttctttttattaatttttactattaaaacttcttatattatttgtttattctttaataaagaaataccaagccc

SEQ ID NO: 476 - DNA, 982 bp, Homo sapiens
agaaaacctagaggccgaagttcaaggttatccatctcaagtagcctagcaatatttgcaacatcccaatggccctgtccttttctttactgatggccgtgctggtgctcagctacaaatccatctgttctctgggctgtgatctgcctcagacccacagcctgggtaataggagggccttgatactcctggcacaaatgggaagaatctctcatttctcctgcctgaaggacagacatgatttcggattccccgaggaggagtttgatggccaccagttccagaaggctcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggactccatcctggctgtgaggaaatacttccaaagaatcactctttatctaacagagaagaaatacagcccttgtgcctgggaggttgtcagagcagaaatcatgagatccctctcgttttcaacaaacttgcaaaaaagattaaggaggaaggattgaaacctggttcaacatggaaatgatcctgattgactaatacattatctcacactttcatgagttcttccatttcaaagactcacttctataaccaccacgagttgaatcaaaattttcaaatgttttcagcagtgtgaagaagcttggtgtatacctgtgcaggcactagtcctttacagatgacaatgctgatgtctctgttcatctatttatttaaatatttatttatttttaaaatttaaattattttttatgtgatatcatgagtacctttacattgtggtgaatgtaacaatatatgttcttcatatttagccaatatattaatttcctttttcattaaa

SEQ ID NO: 477 - DNA, 700 bp, Homo sapiens
gcccaaggttcagggtcactcaatctcaacagcccagaagcatctgcaacctccccaatggccttgccctttgttttactgatggccctggtggtgctcaactgcaagtcaatctgttctctgggctgtgatctgcctcagacccacagcctgagtaacaggaggactttgatgataatggcacaaatgggaagaatctctcctttctcctgcctgaaggacagacatgactttggatttcctcaggaggagtttgatggcaaccagttccagaaggctcaagccatctctgtcctccatgagatgatccagcagaccttcaatctcttcagcacaaaggactcatctgctacttgggatgagacacttctagacaaattctacactgaactttaccagcagctgaatgacctggaagcctgtatgatgcaggaggttggagtggaagacactcctctgatgaatgtggactctatcctgactgtgagaaaatactttcaaagaatcaccctctatctgacagagaagaaatacagcccttgtgcatgggaggttgtcagagcagaaatcatgagatccttctctttatcagcaaacttgcaagaaagattaaggaggaaggaatgaaaactggttcaacatcgaaatgattctcattgactagtacaccatttcacacttcttgagttctgccgtttca

SEQ ID NO: 478 - DNA, 1544 bp, Homo sapiens
tgctcagagttaagttaaatgtcaaatttttaaaaatttaacttttagttaaattactttgccattcctaacagatcaagaaataataaaagtaaactttatgctttttcttttagtgtgcaaagtagacatacatacagtacataaggagatatacaatatatttgttattaaaatttaataaaaatttaatttcaattaagaaaaaaatttcttaaaagactctggaggcaggcaagagaagggagtgtcaataatgaccacatacacacacaaacacacacacaaaactggttgaaaaactactctatacccatgtagagagtaaataaatgaaagcaaaatcagacgtagaaagtaaattctgaaaatggaaactagtatgttccctatttaagacctacacataaagcaaggtcttcagagaacctagagctgaaggttcagagtcacccatctcaacaagtccaacagcatctgcaacatctacaatggctttgccttttgctttactgatggccctggtggtgctcagctgcaagtcaagctgctctctggactgtgatctgcctcagacccacagcctgggtcacaggaggaccatgatgctcctggcacaaatgaggagaatctctcttttctcctgtctgaaggacagacatgacttcagatttccccaggaggagtttgatggcaaccagttccagaaggctgaagccatctctgtcctccatgaggtgattcagcagaccttcaacctcttcagcacaaaggactcatctgttgcttgggatgagaggcttctagacaaactctatactgaactttaccagcagctgaatgacctggaagcctgtgtgatgcaggaggtgtgggtgggagggactcccctgatgaatgaggactccatcctggctgtgagaaaatacttccaaagaatcactctctacctgacagagaaaaagtacagcccttgtgcctgggaggttgtcagagcagaaatcatgagatccttctcttcatcaagaaacttgcaagaaaggttaaggaggaaggaataagacctgatccaacacagaaacgactcccattgacgactacaccagcttgcactttcatgatctgccattttaaagactcttgtttctgctataaccataccatgagttgaatcaaacgcgtcaagtattttcaagtgtgttaagcaacatcgtgttcagttgcacaggaactagtcccttacagatgactaagctgatggatctatttatctatttattaaatgtatatttatttgactataatatttaattttttgcccatataaaagcataaaatgtatacctttatattgttgataacataacaaaatatattttctatgtttagtcgatgtattattttgtttagtttattaaatatttactatagaaaacttcttggatttgtttattctctaaggagaaacaccaagccgattctccaacatgatttaaaaatgtatggttcaattcattgattcattgttattatactcaagttat

SEQ ID NO: 479 - DNA, 737 bp, Homo sapiens
tacccacctcaggtagcctagtgatatttgcaaaatcccaatggcccggtccttttctttactgatggtcgtgctggtactcagctacaaatccatctgctctctgggctgtgatctgcctcagacccacagcctgcgtaataggagggccttgatactcctggcacaaatgggaagaatctctcctttctcctgcttgaaggacagacatgaattcagattcccagaggaggagtttgatggccaccagttccagaagactcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggacttcatcctggctgtgaggaaatacttccaaagaatcactctttatctaatggagaagaaatacagcccttgtgcctgggaggttgtcagagcagaaatcatgagatccttctctttttcaacaaacttgaaaaaaggattaaggaggaaggattgaaaactggttcatcatggaaatgattctcattgactaatgcatcatctcacactttcatgagttcttccatttcaaagactcacttctataaccaccacaagttgaatcaaaatttccaaatgttttc

SEQ ID NO: 480 - DNA, 1039 bp, Homo sapiens
accagctcagcagcatccacaacatctacaatggccttgactttttatttactggtggccctagtggtgctcagctacaagtcattcagctctctgggctgtgatctgcctcagactcacagcctgggtaacaggagggccttgatactcctggcacaaatgcgaagaatctctcctttctcctgcctgaaggacagacatgactttgaattcccccaggaggagtttgatgataaacagttccagaaggctcaagccatctctgtcctccatgagatgatccagcagaccttcaacctcttcagcacaaaggactcatctgctgctttggatgagacccttctagatgaattctacatcgaacttgaccagcagctgaatgacctggagtcctgtgtgatgcaggaagtgggggtgatagagtctcccctgatgtacgaggactccatcctggctgtgaggaaatacttccaaagaatcactctatatctgacagagaagaaatacagctcttgtgcctgggaggttgtcagagcagaaatcatgagatccttctctttatcaatcaacttgcaaaaaagattgaagagtaaggaatgagacctggtacaacacggaaatgattcttatagactaatacagcagctcacacttcgacaagttgtgctctttcaaagacccttgtttctgccaaaaccatgctatgaattgaatcaaatgtgtcaagtgttttcaggagtgttaagcaacatcctgttcagctgtatgggcactagtcccttacagatgaccatgctgatggatctattcatctatttatttaaatctttatttagttaactatctatagggcttaaattagttttgttcatattatattatgtgaacttttacattgtgaattgtgtaacaaaaacatgttctttatatttattattttgccttgtttattaaatttttactatagaaaaattctttatttattctttaaaattgaactccaaccctgattgtgcaaactgattaaagaatggatggt

SEQ ID NO: 481 - DNA, 840 bp, Homo sapiens
acattctaactgcaacctttcgaagcctttgctctggcacaacaggtagtaggcgacactgttcgtgttgtcaacatgaccaacaagtgtctcctccaaattgctctcctgttgtgcttctccactacagctctttccatgagctacaacttgcttggattcctacaaagaagcagcaattttcagtgtcagaagctcctgtggcaattgaatgggaggcttgaatactgcctcaaggacaggatgaactttgacatccctgaggagattaagcagctgcagcagttccagaaggaggacgccgcattgaccatctatgagatgctccagaacatctttgctattttcagacaagattcatctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctaaggaacttttacttcattaacagacttacaggttacctccgaaactgaagatctcctagcctgtgcctctgggactggacaattgcttcaagcattcttcaaccagcagatgctgtttaagtgactgatggctaatgtactgcatatgaaaggacactagaagattttgaaatttttattaaattatgagttatttttatttatttaaattttattttggaaaataaattatttttggtgcaaaagtca

SEQ ID NO: 482 - DNA, 1630 bp, Homo sapiens
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatca

SEQ ID NO: 483 - DNA, 629 bp, Homo sapiens
gttctcagtcaagctgaagtgaaaacgagaccaaggtctagctctactgttggtacttatgagatccagtcctggcaacatggagaggattgtcatctgtctgatggtcatcttcttggggacactggtccacaaatcaagctcccaaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgctttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaagatgattcatcagcatctgtcctctagaacacacggaagtgaagattcctgaggatctaacttgcagttggacactatgttacatactctaatatagtagtgaaagtcatttctttgtattccaagtggaggag

SEQ ID NO: 484 - DNA, 2076 bp, Homo sapiens
acatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataacttgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgtattaa

SEQ ID NO: 485 - DNA, 817 bp, Homo sapiens
acatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattgaatcagccctacaaaaagaaagaaaaaagaacagaaaggaagcagcaatcagctatgagcaataattag

SEQ ID NO: 486 - DNA, 393 bp, Homo sapiens
gtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactga

SEQ ID NO: 487 - DNA, 1940 bp, Homo sapiens
cacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattgaatcagccctacaaaaagaaagaaaaaagaacagaaaggaagcagcaatcagctatgagcaataattagacattcgtttgctagctctagcacatgtgaccatgaagagtaactgtgaaccatattgactttctctcctgaaaagaaaaatatgaaaaaaattcagaagaaaactgtcctatcacaaagaatacagaaattgggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttgaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaa

SEQ ID NO: 488 - DNA, 400 bp, Homo sapiens
cagaccatgttccatgtttcttttaggtatatctttggacttcctcccctgatccttgttctgttgccagtagcatcatctgattgtgatattgaaggacagcatgaaagaaattggtagcaattgcctgaataatgaatttaacttttttaaaagacatatctgtgatgctaataaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctcc

SEQ ID NO: 489 - DNA, 456 bp, Homo sapiens
cagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctcc

SEQ ID NO: 490 - DNA, 1055 bp, Homo sapiens
tccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctcc

SEQ ID NO: 491 - DNA, 195 bp, Homo sapiens
atgaaagaaattggtagcaattgcctgaataatgaatttaacttttttaaaagacatatctgtgatgctaataaggaagaaaataaatctttaaaggaacagaaaaaactgaatgacttgtgtttcctaaagagactattacaagagataaaaacttgttggaataaaattttgatgggcactaaagaacactga

SEQ ID NO: 492 - DNA, 1642 bp, Homo sapiens
ccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatccca

SEQ ID NO: 493 - DNA, 1948 bp, Homo sapiens
aacagagggagctccgagccctctctggcgcgcgaggtatttcgtctgtccccgggggtgccaggtgagccccagcggatccgggagggtaagctgggactcctcgcgagcagtagctgcagggtaccaagcttcgccctctgcgtccccgcgccttcgcggtctcccgccagtgcaggtccggggcccccaggcgagcggacaaggttggcctaatctgccaaacttctggggcatttaccgtgctctggccgccctcccgattcttccctccgcgcccttgcctgcttctcgcctaccccgggctccggaagggaaggaggcgtgtccggagcaggcgggcgggaactgtataaaagcgccggcggctcagcagccgggcttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatccca

SEQ ID NO: 494 - DNA, 93 bp, Homo sapiens
gggatggatgttttgggaaggccaaaaatccccctggagactccagcctacactgggcagccatggcattgccagcattgttttctcttataa

SEQ ID NO: 495 - DNA, 5006 bp, Homo sapiens
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggctgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaatggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatcata

SEQ ID NO: 496 - DNA, 1925 bp, Homo sapiens
ccccgacgaagccgctccagggctgctctcagaggacgcgcggcaggcaaagagaatgaacctgagcgtccacgaaacgtcctgcacggctcccgggagctgggagaaacaggtgcctttctccgacgtccgcgggcgacgcctgccgcaccttgcccgctgccgcgcccctcccgggcacccctcgccctcggcgcccctgcccccgcccccagtgccagggcggaggcagtcccggctcgcaggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtaagtcagctgacaaaaccaatcagcagtctcaccaagccctatcactagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggctgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcag

SEQ ID NO: 497 - DNA, 2813 bp, Homo sapiens
ctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaa

SEQ ID NO: 498 - DNA, 800 bp, Homo sapiens
gaggaccggtgggacgcgccggaacgacggccgaaagccgcccctgactctcctgtctccgctccctgccttgctcgcaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagta

SEQ ID NO: 499 - DNA, 822 bp, Homo sapiens
actcctctggccttctcttgaggctcccagttcacgctgcacagtgctgggcactgcctcctctccacacccctagcgccccccacccctcagcagaagggcccgcgaggaaccgtgcgaggtcaggccgagcgccggcaccgccaccggcactggcgctgagcgacgagagcggactcctgcgagcgcagagagggagggggagatggagggctggatgagtcacgcggataatcgcgctcttctccagcgcgcagacagcgcggcaagcgcgtatgctagcaggggtgcggacgcgtgaccgtgccgcccgctgaccccaccagtcttcgcgggcttcgaacccagggagccgacaatggcgttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgt

SEQ ID NO: 500 - DNA, 545 bp, Homo sapiens
ggcagtttcccgaccagagagaacgaacgtgtctgcgggcgcgcggggagcagaggcggtggcgggcggcggcggcaccgggagccgccgagtgaccctcccccgcccctctggccccccaccctcccacccgccgcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcagg

SEQ ID NO: 501 - DNA, 1887 bp, Homo sapiens
tttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaagccctgatggctatgtttcaggttgaagggaggcactagagtcccacactaggtttcactcctcaccagccacaggctcagtgctgtgtgcagtgaggcaagatgggctctgctgaggcctgggactgagct

SEQ ID NO: 502 - DNA, 1146 bp, Homo sapiens
aggtcgcgcccctcagtgcccgcgctctccccgtcgggagcttcctggtcgcccctgcggcggcggctcggggtgtctggccggcgcggggctcgcccagcctggtccggggagaggactggctgggcaggggcgccgccccgcctcgggagaggcgggccgggcggggctgggagtatttgaggctcggagccaccgccccgccggcgcccgcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatatta

SEQ ID NO: 503 - DNA, 3458 bp, Homo sapiens
cctttgccttcggacttctccggggccagcagccgcccgaccaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagttttgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttcttttttttttttttttaaaatggagtctcactgtgtcacccaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgc

SEQ ID NO: 504 - DNA, 4008 bp, Homo sapiens
gtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagttttgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttcttttttttttttttttaaaatggagtctcactgtgtcacccaggctggagtgcagtggcatgatcggctcactgcagcctctgcctcttgggttcaagtgattctcctgcctcagcctcctgagtagctgggatttcaggcacccgccacactcagctaatttttgtatttttagtagagacggggtttcaccatgttgtccaggctggtctggaactcctgacctcaggtgatctgcccaccttggcttcccaaagtgctgggattacaggcatgagccaccatgctgggccaaccatttcttggtgtattcatgccaaacacttaagacactgctgtagcccaggcgcggtggctcacacctgtaatcccagcactttggaaggctgaggcgggcggatcacaaggtcacgagttcaaaactatcctggccaacacagtgaaaccccgtctctactaaaatacaaaaaaattagccgggtgtggtggtgcatgcctttagtcctagctattcaggaggctgaggcaggggaatcgcttgaacccgagaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaa

SEQ ID NO: 505 - DNA, 753 bp, Homo sapiens
agctcctgattctgcagaaaacacgaaactgagctgtacaaagatgctgatgaggggctgcagcatgcaattcacttcaccagcagtcactaagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattac

SEQ ID NO: 506 - DNA, 2782 bp, Homo sapiens
gcgtaggcgacgcgctggtagagctgtggacctgccagcctgcgaggcggaggacgggctccatctcttagaaacgcctacggcgcatgctctatggggtcaactggggggctggcaagcggcagcgctggtctggggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaagaa

SEQ ID NO: 507 - DNA, 2506 bp, Homo sapiens
aaatcgaaactaaacgtaagcttcagaaaccgaaacttaatagaagagctcaagagccgcggccagacgtttgcggagtccagggtctttcggagttgaatttgcagctgggctccttcactttggtctcggcttttatctgcctccctgataggtttttggtcttggtgacttcaagaatgaagctgcggactctcgctgtgagtgctacagttgttaaagatggcgtgtctggagtttgttcctttcgatgttcagatgtgtctggagttcttccttctggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggccc

SEQ ID NO: 508 - DNA, 3131 bp, Homo sapiens
ttttgattgtcagctcctgattctgcagaaaacacgaaactgagctgtacaaagatgctgatgaggggctgcagcatgcaattcacttcaccagcagtcactaaggtctgatctcttttctaaccatacctggaagatggaatgctggacccaggaaggctttgacatatcaatgcaccagggatcttaccaaactaaattttaagcacttatagctcaagattctccctctgagatgaaacatacttccaccctgtcatgtgtcagcttcagaagatatcaattgctcaagaaagtgttggacaagcagaaaagcacactgaacatttctggacttgtgaaagagctctgaatatggatctctcagggatattccatccccaccaatgctttaccaatgcgagagctggccaggctgagacatttaatgataacatggaacaatttattcaggaagatagtcaactactcatgtggctttatgattataaaacccactgaaaattgggtcccttgattctcttgatttttcctaagccttactccctaaagtctccaatttgatgaggtatttgatacttgatctctccttgaagtaaaatttggagcaaaatatattggactggaaggcctgagacctcgataagaagaaacatgaaccccagagccacagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaag

SEQ ID NO: 509 - DNA, 2513 bp, Homo sapiens
aaatcgaaactaaacgtaagcttcagaaaccgaaacttaatagaagagctcaagagccgcggccagacgtttgcggagtccagggtctttcggagttgaatttgcagctgggctccttcactttggtctcggcttttatctgcctccctgataggtttttggtcttggtgacttcaagaatgaagctgcggactctcgctgtgagtgctacagttgttaaagatggcgtgtctggagtttgttcctttcgatgttcagatgtgtctggagtttcttccttctggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaagaa

SEQ ID NO: 510 - DNA, 2743 bp, Homo sapiens
cagccccagcaagaacaggaaactggagattgaatcagatgccgagcgctcagaaactgaaacttaagaaatcgaaactaaacgtaagcttcagaaaccgaaacttaatagaagagctcaagagccgcggccagacgtttgcggagtccagggtctttcggagttgaatttgcagctgggctccttcactttggtctcggcttttatctgcctccctgataggtttttggtcttggtgacttcaagaatgaagctgcggactctcgctgtgagtgctacagttgttaaagatggcgtgtctggagtttgttcctttcgatgttcagatgtgtctggagtttcttccttctggtgagttcgtggtcttgctgacttcaggagtgcagctgcagaccttcacagtgagtgttacagatcttaaaggtggcgcgtccggagttgttcgttcctcccggtgggttcgtggtttcactgacttcaggagtaaagccgtagacctttgtggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagagttcctttcttggattacagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttat

SEQ ID NO: 511 - DNA, 1055 bp, Homo sapiens
taaaatttaaaaattccttattctcctttcagatatggctggagtcatttgtttcatattttcctttcaccttttacttgccctaaatctggttcagaactttttgtgggagcattaagttaccagaatatttttgtgtagtaaaattcaagcaaataataatagactgttttattatacagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgca

SEQ ID NO: 512 - DNA, 2651 bp, Homo sapiens
ttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccaggtgagagtgccggcgccgcggcgctgccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggccc

SEQ ID NO: 513 - DNA, 84 bp, Homo sapiens
ctctgttttcttctgtgtggatttaatgagagaaatttaaatatggctgttaaattccaaaagtttcaagcctttgactgggga

SEQ ID NO: 514 - DNA, 2834 bp, Homo sapiens
tggagggcagaaggctttgacatatcaatgcaccagggatcttaccaaactaaattttaagcacttatagctcaagattctccctctgagatgaaacatacttccaccctgtcatgtgtcagcttcagaagatatcaattgctcaagaaagtgttggacaagcagaaaagcacactgaacatttctggacttgtgaaagagctctgaatatggatctctcagggatattccatccccaccaatgctttaccaatgcgagagctggccaggctgagacatttaatgataacatggaacaatttattcaggaagatagtcaactactcatgtggctttatgattataaaacccactgaaaattgggtcccttgattctcttgatttttcctaagccttactccctaaagtctccaatttgatgaggtatttgatacttgatctctccttgaagtaaaatttggagcaaaatatattggactggaaggcctgagacctcgataagaagaaacatgaaccccagagccacagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaag

SEQ ID NO: 515 - DNA, 936 bp, Homo sapiens
actgcgactcgagacagcggcccggcaggacagctccaggtgagagtgccggcgccgcggcgctgccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagt

SEQ ID NO: 516 - DNA, 3846 bp, Homo sapiens
tttaacgtgaatcgatgtaaacctgtgtttggtgcttagacagggggcccccgggtagagtggaaccccttaagctaagcgaacaggagcctaacaaagcaaatttttccgtctgccctttccccctcttctcgttggcagggttgatcctcattactgtttgctcaaacgtttagaagtgaatttaggtccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccac

SEQ ID NO: 517 - DNA, 560 bp, Homo sapiens
aacagtttgtatgctggaagagttctgaaaagatctctgagggctggaagtgctaaggacaatttcataaagaagaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtat

SEQ ID NO: 518 - DNA, 559 bp, Homo sapiens
aaactttccctccttggaaaacagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactc

SEQ ID NO: 519 - DNA, 629 bp, Homo sapiens
gacaaacaggattcgtcaaaagagaggtgtattaaagtgccgatcaaatgtaatttaacagctaaactttccctccttggaaaacagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaact

SEQ ID NO: 520 - DNA, 3335 bp, Homo sapiens
atggagagcaaagccctgctcgtgctgactctggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccaca

SEQ ID NO: 521 - DNA, 3737 bp, Homo sapiens
ccgtctgccctttccccctcttctcgttggcagggttgatcctcattactgtttgctcaaacgtttagaagtgaatttaggtccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccaca

SEQ ID NO: 522 - DNA, 2333 bp, Homo sapiens
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtctgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggctt

SEQ ID NO: 523 - DNA, 2768 bp, Homo sapiens
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgctcccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggccc

SEQ ID NO: 524 - DNA, 2429 bp, Homo sapiens
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtcctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctc

SEQ ID NO: 525 - DNA, 3144 bp, Homo sapiens
gccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgt

SEQ ID NO: 526 - DNA, 3617 bp, Homo sapiens
ctcttgcagtgaggtgaagacatttgaaaatcaccccactgcaaactcctccccctgctagaaacctcacattgaaatgctgtaaatgacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgta

SEQ ID NO: 527 - DNA, 2656 bp, Homo sapiens
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgacttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttc

SEQ ID NO: 528 - DNA, 5337 bp, Homo sapiens
aggggaggcctggcgttcctccgcggttcctgtcacaaaggcgacgacaagtcccgggtccccggagccgcctccgcgacatacacgagtcgccctccgttatcctgggccctcctggcgaagtccccggtttccgctgtgctctgtggcgacacctccgtccccaccttgtcctggggggcgccctcgccccaccagccccgatcaagttcacagaggggcccccggccaccctcaaggcctcggttccttacgaggttgaaacgttgcctcagaatctccccgcccctccttggtctgcagccgagatcttcagccacgtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaa

SEQ ID NO: 529 - DNA, 523 bp, Homo sapiens
gcaccaaggatggagatgctccaggggctgctgctgttgctgctgctgagcatgggcggggcatgggcatccagggagccgcttcggccatggtgccaccccatcaatgccatcctggctgtcgagaaggagggctgcccagtgtgcatcaccgtcaacaccaccatctgtgccggctactgccccaccatgatgcgcgtgctgcaggcggtcctgccgcccctgcctcaggtggtgtgcacctaccgtgatgtgcgcttcgagtccatccggctccctggctgcccgcgtggtgtggaccccgtggtctccttccctgtggctctcagctgtcgctgtggaccctgccgccgcagcacctctgactgtgggggtcccaaagaccaccccttgacctgtgaccacccccaactctcaggcctcctcttcctctaaagaccctccccgcagccttccaagtccatcccgactcctggagccctgacaccccgatcctcccacaataaaggcttctcaatccgca

SEQ ID NO: 530 - DNA, 583 bp, Homo sapiens
cgggaagggtctctgggtctttgtgggtggtgtaccacgcgggatgggaaggccaggactcggggctgcggtctcagacctgggtgaagcagtgtccttgtcccaggggctgctgctgttgctgctgctgagcatgggcggggcatgggcatccagggagccgcttcggccatggtgccaccccatcaatgccatcctggctgtcgagaaggagggctgcccagtgtgcatcaccgtcaacaccaccatctgtgccggctactgccccaccatgatgcgcgtgctgcaggcggtcctgccgcccctgcctcaggtggtgtgcacctaccgtgatgtgcgcttcgagtccatccggctccctggctgcccgcgtggtgtggaccccgtggtctccttccctgtggctctcagctgtcgctgtggaccctgccgccgcagcacctctgactgtgggggtcccaaagaccaccccttgacctgtgaccacccccaacaggcctcctcttcctctaaagaccctccccgcagccttccaagtccatcccgactcctggagcccgacaccccgatcctcccacaataa

SEQ ID NO: 531 - DNA, 599 bp, Homo sapiens
cggccagggcgccgacagcccgacctcaccaggagaacatgcagctcggcactgggctcctgctggccgccgtcctgagcctgcagctggctgcagccgaagccatatggtgtcaccagtgcacgggcttcggagggtgctcccatggatccagatgcctgagggactccacccactgtgtcaccactgccacccgggtcctcagcaacaccgaggatttgcctctggtcaccaagatgtgccacataggctgccccgatatccccagcctgggcctgggcccctacgtatccatcgcttgctgccagaccagcctctgcaaccatgactgacggctgccctcctccaggcccccggacgctcagcccccacagcccccacagcctggcgccagggctcacagctgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaa

SEQ ID NO: 532 - DNA, 3170 bp, Homo sapiens
ggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaaga

SEQ ID NO: 533 - DNA, 560 bp, Homo sapiens
aagaggaggcggagacagctatggggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacg

SEQ ID NO: 534 - DNA, 3184 bp, Homo sapiens
ctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 535 - DNA, 3147 bp, Homo sapiens
ctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 536 - DNA, 3169 bp, Homo sapiens
tccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaagctgctgtggacctggtctcctgtgtccagcccagccttgggcctgcctcgcagctgtgaggatggctccaattcctgcctcctggcgggagactgaggctcaggggaatggtatcttgttcaagaccatttggcaactgagagggagagcagatgtcaggaggagctacacccacattccggggaggggccgctgctgggtggggggcacgtggggacctgcactcatgcaagcttctgctctgctgcacccaccagccccgtccttgcccgcacccttgcctgcttccctggctggctcccacttgcctcccgtgccaggtgcttctggggctcagcaggagaggaaaggggcagaggggcatagggtccctcgggtacggtgggggcaggcgggcgcacagcgctccggctctgagccaggcctgtgagggaaggggctgcaggctggcagggtgccgacttcccccatggctgctgtgagcccgcagagtcatccttggccccgtcccgcccttggggaagaatgggcccctctgtcctcaggccccttcgacgtgctgagcatccagacgtggcgaggagcccgaagggtgtggggtcccctctgcagggtcctgcttgttgcctgtttccggcgggcggggtgcacaatggggtctctaaggaccgtttcccgccactggccccattgtcactgtctccgccttcctcctcggcctttcagccgcataaagggccagtgaggtttgggacagccacagcccaaggctccgaggctaaaagcccctgggtgggggtgttccaggacacctggccctgtgtgagctgcctcctctcaccccaacccctcggatcctgggaaagagacagccatggctcaagggccagggacccctgggctgagccccagaaatggctttccattctcgcctgggccggggtgggggtggaggccagaggccctgcccaggcagatgaagcccccagctttcaagggggaaactgaggctgtgtgagggacacagctgtgcagggcccacaaacacggtcctttctctaggttagcggatgcagatgcctgatgagtgccatgccctctgtggacacctggggaggggggtcacctccagcgccgccctgggacttccactgcacgtgcaagagacttaccctttcacacagatcacctgcctgccgcagggctgatgaggatgggtgaggagcgcagccactgggtgtcatgcactgtgggggttctcccaccttctgcccctcctcaggttccttgctgcttctctcctctcccaactgtggcacgctgagggctcaggcacaggaccgctcctctggggcagcctccaataacccttggacaacctccactttttcatcttcagccctgaccactccctggggcccatagccttacatccatctgcccccagcccaaacacttctgcaaacactagaaaaggaggtagcccgtgtgccctcctgcaccgcctcctccactcctgtcttggagaggctttcccgtgggccgagcaacccccttacctttggcacttgccctgattctctggccagcttcctacaacctctccttttcagccacacccaagtccacctgttcacaaacaccctgggctgggccctggccgaaccctggcttctacctacctgtctcaggaagtgcctgagccttgcacctacagaccctcccagagaaagccctggctttgcaaccagctgtcttctcatgagacacagggccacaggagcaccacggtgcccaaatgggtcttggagcattagaccaggggcttcatgcctgccctggggacaggtggccaaagtggcatgggagatagggagacagtgtgggtgagcaggtgggcaggagctacaggagcctggggcctgtggatcacagacaccgccaggcaagtgccagttcacacaggtacaggtggctgcagagtgcccaaaggccaagcagcagagtgcctggtgtgg

SEQ ID NO: 537 - DNA, 1103 bp, Homo sapiens
cgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaa

SEQ ID NO: 538 - DNA, 3749 bp, Homo sapiens
cctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaagcttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcataagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaattta

SEQ ID NO: 539 - DNA, 1962 bp, Homo sapiens
acacgatatttggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcataagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaattta

SEQ ID NO: 540 - DNA, 4037 bp, Homo sapiens
acctacgtttaatcattaatagtgagcccttcagtgaacttaggtcctgattttggagtttggagtctgacctttccccaaagataaacatgattgttgcaggttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatca

SEQ ID NO: 541 - DNA, 4092 bp, Homo sapiens
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatcata

SEQ ID NO: 542 - DNA, 549 bp, Homo sapiens
agtagggggctgcatggcacgcgcccctttgcgtccagagaataccatagtgcgggggagcgccaaccagtgccaggacacttaccgagctgaagagttgacaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtaga

SEQ ID NO: 543 - DNA, 3855 bp, Homo sapiens
tgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatc

SEQ ID NO: 544 - DNA, 5701 bp, Homo sapiens
agacccgggcggcgccggccgcctcgccggccgcaggtccgcctccgccgcgccgagggcgtgggctcccggctcccggaagcggcggccgcggcgcggagccgagcgggcgtccgtcgccggagctgcaatgagcggcgcccggaggctgtgacctgcgcgcggcggcccgaccggggcccctgaatggcggctcgctgaggcggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggctttgtctgcccatgccgattgacgttgtttacacctgggtgaatggcacagatcttgaactactgaaggaactacagcaggtcagagaacagatggaggaggagcagaaagcaatgagagaaatccttgggaaaaacacaacggaacctactaagaagagtgagaagcagttagagtgtttgctaacacactgcattaaggtgccaatgcttgtcctggacccagccctgccagccaacatcaccctgaaggacctgccatctctttatccttcttttcattctgccagtgacattttcaatgttgcaaaaccaaaaaacccttctaccaatgtctcagttgttgtttttgacagtactaaggatgttgaagatgcccactctggactgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactgttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgaca

SEQ ID NO: 545 - DNA, 1678 bp, Homo sapiens
cggagctgcaatgagcggcgcccggaggctgtgacctgcgcgcggcggcccgaccggggcccctgaatggcggctcgctgaggcggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggctttgtctgcccatgccgattgacgttgtttacacctgggtgaatggcacagatcttgaactactgaaggaactacagcaggtcagagaacagatggaggaggagcagaaagcaatgagagaaatccttgggaaaaacacaacggaacctactaagaagagtgagaagcagttagagtgtttgctaacacactgcattaaggtgccaatgcttgtcctggacccagccctgccagccaacatcaccctgaaggacctgccatctctttatccttcttttcattctgccagtgacattttcaatgttgcaaaaccaaaaaacccttctaccaatgtctcagttgttgtttttgacagtactaaggatgttgaagatgcccactctggactgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactgttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggtaaggatgtgttaaactgtaattcgttcatttttatggaatattttcttcttaatcattattgaacatgtgctatagacttaaccaaacattctttatgtattaataaagaatcagtaatgctggg

SEQ ID NO: 546 - DNA, 2069 bp, Homo sapiens
atggcgacggcgctgatggctgtggttctgcgggcagctgctgtagccccgaggctgagaggccggggaggcactgggggcgcccgaaggctgagctgtggcgcgcggcggcgggcggcgaggggcaccagcccggggcgccggctcagcaccgcctggtcgcagccccagcccccgcccgaggagtacgcgggcgcggacgacgtctcccagtcgcccgtcgccgaggagccgtcgtgggtgccgagtcccaggcccccggtgccccacgagtccccagagcctccttcgggccgctcgctggtgcagcgggacatccaggccttcctgaaccagtgcggggccagccctggggaggcgcgccactggctcacgcagttccagacctgccatcactccgcggacaagcccttcgccgtcatcgaggtggacgaggaggtgctcaagtgccagcagggcgtatccagtctggcctttgccctggccttcttgcagcgcatggacatgaagccgctggtggtcctggggctgccggcccctacggctccctcgggctgtctttccttctgggaggccaaggcgcagctggccaagagctgcaaggtgctggtagacgcgcttcgacacaacgccgccgctgctgtgccattttttggcggcgggtctgtgctacgcgctgccgagccggctccccatgccagctacggcggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtcctgagtaacgtgaacctgcccgccgacctggacctggtgtgcaacgccgagtgggtgagcacaaaagaacggcagcagatgcggctcatcgtggacgtgctcagccgcctgccccaccactcctcggccgtcatcaccgccgctagcacgctgctcactgagctctttagcaacaaggggtccgggaccctgttcaagaacgccgagcgaatgctacgggtgcgcagcctggacaagctggaccagggccgtctagtggacctggtcaacgccagcttcggcaagaagctcagggacgactacctggcctcgctgcgcccgcggctgcactccatctacgtctccgaggggtacaacgccgccgccattctgaccatggagcccgtcctggggggcaccccgtacctggacaaatttgtggtgagctccagccgccagggccaaggctccggccagatgctgtgggagtgcctgcggcgggaccttcagacacttttctggcgctcccgggtcaccaaccccatcaatccctggtacttcaaacacagtgatggcagcttctccaacaagcagtggatcttcttctggtttggcctggctgatatccgggactcctatgagttggtcaaccacgccaagggactgccagactcctttcacaagccagcttctgacccaggcagctgaccctcaccatggacactacaggccctggaatggccagggtggaccaaaagccatgccagctgggcatgaccccaggcagccagccacaggctgaagggggcttgttggctgagtgatctgcagaggagaaagcagccccagctctgcccagaggaggcgctgaagtgggacaagcacaggaaagaaggggaccagtctaggaccccaactcgactcactctaaagctacaaccaaatggccttcgattttcaacctggggattaggggaggggagggtgccttccagggctctactcaggactaaccctaagggtgagctagtttctgtgcctctgtgctatgttttgaggctcccttacccaaaataatacccctgcctgcgtgatattctaccattcattttaattcctttgggtcttgcagtttttcaggaggccttgattaaaatgcaaatacttgtctg

SEQ ID NO: 547 - DNA, 1388 bp, Homo sapiens
catggcgacggcgctgatggctgtggttctgcgggcagctgctgtagccccacgagtccccagagcctccttcgggccgctcgctggtgcagcgggacatccaggccttcctgaaccagtgcggggccagccctggggaggcgcgccactggctcacgcagttccagacctgccatcactccgcggacaagcccttcgccgtcatcgaggtggacgaggaggtgctcaagtgccagcagggcgtatccagtctggcctttgccctggccttcttgcagcgcatggacatgaagccgctggtggtcctggggctgccggcccctacggctccctcgggctgtctttccttctgggaggccaaggcgcagctggccaagagctgcaaggtgctggtagacgcgcttcgacacaacgccgccgctgctgtgccattttttggcggcgggtctgtgctacgcgctgccgagccggctccccatgccagctacggcggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtcctgagtaacgtgaacctgcccgccgacctggacctggtgtgcaacgccgagtgggtgagcacaaaagaacggcagcagatgcggctcatcgtggacgtgctcagccgcctgccccaccactcctcggccgtcatcaccgccgctagcacgctgctcactgagctctttagcaacaaggggtccgggaccctgttcaagaacgccgagcgaatgctacgggtgcgcagcctggacaagctggaccagggccgtctagtggacctggtcaacgccagcttcggcaagaagctcagggacgactacctggcctcgctgcgcccgcggctgcactccatctacgtctccgaggggtacaacgccgccgccattctgaccatggagcccgtcctggggggcaccccgtacctggacaaatttgtggtgagctccagccgccagggccaaggctccggccagatgctgtgggagtgcctgcggcgggaccttcagacacttttctggcgctcccgggtcaccaaccccatcaatccctggtacttcaaacacagtgatggcagcttctccaacaagcagtggatcttcttctggtttggcctggctgatatccgggactcctatgagttggtcaaccacgccaagggactgccagactcctttcacaagccagcttctgacccaggcagctga

SEQ ID NO: 548 - DNA, 2609 bp, Homo sapiens
ggctcggtccgactattgcccgcggtgggggagggggatggatcacgccacgcgccaaaggcgatcgcgactctccttctgcaggtagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccagtgctaaaggttatagtgaattctctgaagaatatgataaatacattcgtgccaagtggaaaaattatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgtcatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgat

SEQ ID NO: 549 - DNA, 1690 bp, Homo sapiens
gggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaactgtcttccctgctgttataaggtacagaggtgcagttccatggtacaccataaatcttgacttaccaccctacaaaagatggcatgaattgatgcttgacaaggcaccagtgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgtcatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtg

SEQ ID NO: 550 - DNA, 2511 bp, Homo sapiens
ggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccagtgctaaaggttatagtgaattctctgaagaatatgataaatacattcgtgccaagtggaaaaattatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgtcatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctga

SEQ ID NO: 551 - DNA, 2231 bp, Homo sapiens
gctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccagtgctaaaggttatagtgaattctctgaagaatatgataaatacattcgtgccaagtggaaaaattatgcaggtggtggatgaaaaattgcctggcctacttggcaactttcctggcccttttgaagaggaaatgaagggtattgccgctgttactgatatacctttaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgtcatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagag

SEQ ID NO: 552 - DNA, 2507 bp, Homo sapiens
ggctcggtccgactattgcccgcggtgggggagggggatggatcacgccacgcgccaaaggcgatcgcgactctccttctgcaggtagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccagtgctaaaggttatagtgaattctctgaagaatatgataaatacattcgtgccaagtggaaaaattatgcaggtggtggatgaaaaattgcctggcctacttggcaactttcctggcccttttgaagaggaaatgaagggtattgccgctgttactgatatacctttaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgtcatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagag

SEQ ID NO: 553 - DNA, 694 bp, Homo sapiens
gcaggctgagggcaggtgggaagcaaacccggacgcatcgcagcagcagcagcagcagcagaagcagcagcagcagcctccgcagtccctccagagacatggatccccagacagcaccttcccgggcgctcctgctcctgctcttcttgcatctggctttcctgggaggtcgttcccacccgctgggcagccccggttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagccccaagatggtgcaagggtctggctgctttgggaggaagatggaccggatcagctcctccagtggcctgggctgcaaagtgctgaggcggcattaagaggaagtcctggctgcagacacctgcttctgattccacaaggggctttttcctcaaccctgtggccgcctttgaagtgactcatttttttaatgtatttatgtatttatttgattgttttatataagatggtttcttacctttgagcacaaaatttccacggtgaaataaagtcaacattataagcttta

SEQ ID NO: 554 - DNA, 1047 bp, Homo sapiens
agagagcgctgggagccggaggggagcgcagcgagttttggccagtggtcgtgcagtccaaggggctggatggcatgctggacccaagctcagctcagcgtccggacccaataacagttttaccaagggagcagctttctatcctggccacactgaggtgcatagcgtaatgtccatgttgttctacactctgatcacagcttttctgatcggcatacaggcggaaccacactcagagagcaatgtccctgcaggacacaccatcccccaagcccactggactaaacttcagcattcccttgacactgcccttcgcagagcccgcagcgccccggcagcggcgatagctgcacgcgtggcggggcagacccgcaacattactgtggaccccaggctgtttaaaaagcggcgactccgttcaccccgtgtgctgtttagcacccagcctccccgtgaagctgcagacactcaggatctggacttcgaggtcggtggtgctgcccccttcaacaggactcacaggagcaagcggtcatcatcccatcccatcttccacaggggcgaattctcggtgtgtgacagtgtcagcgtgtgggttggggataagaccaccgccacagacatcaagggcaaggaggtgatggtgttgggagaggtgaacattaacaacagtgtattcaaacagtacttttttgagaccaagtgccgggacccaaatcccgttgacagcgggtgccggggcattgactcaaagcactggaactcatattgtaccacgactcacacctttgtcaaggcgctgaccatggatggcaagcaggctgcctggcggtttatccggatagatacggcctgtgtgtgtgtgctcagcaggaaggctgtgagaagagcctgacctgccgacacgctccctccccctgccccttctacactctcctgggcccctccctacctcaacctgtaaattattttaaattataaggactgcatggtaatttatagtttatacagttttaaagaatcattatttattaaatttttggaagc

SEQ ID NO: 555 - DNA, 3068 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgattt

SEQ ID NO: 556 - DNA, 2483 bp, Homo sapiens
gtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaa

SEQ ID NO: 557 - DNA, 2981 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgattt

SEQ ID NO: 558 - DNA, 3092 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaagcattctggagaaccctttccagaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgattt

SEQ ID NO: 559 - DNA, 3127 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgattt

SEQ ID NO: 560 - DNA, 3083 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgattt

SEQ ID NO: 561 - DNA, 2354 bp, Homo sapiens
aaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaatt

SEQ ID NO: 562 - DNA, 1785 bp, Homo sapiens
ggcagcagcatggggaaaggacgcgcgggccgagttggcaccacagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaac

SEQ ID NO: 563 - DNA, 1955 bp, Homo sapiens
ttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaagg

SEQ ID NO: 564 - DNA, 1330 bp, Homo sapiens
atggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaa

SEQ ID NO: 565 - DNA, 1769 bp, Homo sapiens
tcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgc

SEQ ID NO: 566 - DNA, 1716 bp, Homo sapiens
agcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacagctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaataga

SEQ ID NO: 567 - DNA, 2359 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctg

SEQ ID NO: 568 - DNA, 1585 bp, Homo sapiens
aggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtgtggacaaccactacaaaataaagtgcagctgaagggccgtgaccttctcactctaaaaaactttaccggagaagaaattaaatatatgctatggctatcagcagatctgaaatttaggataaaacagaaaggagagtatttgcctttattgcaagggaagtccttaggcatgatttttgagaaaagaagtactcgaacaagattgtctacagaaacaggctttgcacttctgggaggacatccttgttttcttaccacacaagatattcatttgggtgtgaatgaaagtctcacggacacggcccgtgtattgtctagcatggcagatgcagtattggctcgagtgtataaacaatcagatttggacaccctggctaaagaagcatccatcccaattatcaatgggctgtcagatttgtaccatcctatccagatcctggctgattacctcacgctccaggaacactatagctctctgaaaggtcttaccctcagctggatcggggatgggaacaatatcctgcactccatcatgatgagcgcagcgaaattcggaatgcaccttcaggcagctactccaaagggttatgagccggatgctagtgtaaccaagttggcagagcagtatgccaaagagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaagactgctaaagttgctgcctctgactggacatttttacactgcttgcccagaaagccagaagaagtggatgatgaagtcttttattctcctcgatcactagtgttcccagaggcagaaaacagaaagtggacaatcatggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaacaaatccctaacacgtggtatgggtgaaccgtatgatatgctttgccattgtgaaactttccttaagcctttaatttaagtgctgatgcactgtaatacgtgcttaactttgcttaaactctctaattcccaatttctgagttacatttagatatcatattaattatcatatacatttacttcaacataaaatactgtgttcataatgtataatgtctaagccattaagtgtaatctatgcttattacctaaataaattatcacccatgctaattta

SEQ ID NO: 569 - DNA, 813 bp, Homo sapiens
aaaagtcaccatttaaggggtctgcagtccaattcatcagttgtctttagtttactcagcatcagctactaacatacctgaacgaagatcttgttctaagacattgtatgtgaagatgatacctgcaaaagacatggctaaagttatgattgtcatgttggcaatttgttttcttacaaaatcggatgggaaatctgttaagaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtgaaaatgaaaacagatattgtcagagttctgctctagacagtgtagggcaacaatacatgctgctaattcaaagctctattaagatttccaagtgccaatatttctgatataacaaactacatgtaatccatcactagccatgataactgcaattttaattgattattctgattccacttttattcatttgagttattttaattatcttttctattgtttattctttttaaagtatgttattgcataatttataaaagaataaaattgcacttttaaacctctcttctaccttaaaatgtaaaacaaaaatgtaatgatcataagtctaaataaatgaagtatttctcactc

SEQ ID NO: 570 - DNA, 799 bp, Homo sapiens
ccttttagtatccaattatctgaaacttaagaagagtgtgcaccgcccaatgggtgtgtgtatgtgctgctttgaacctatagttgagatccagagaattgggagtgacatcatctgtaacaataaaagagcctctcttgtgaagatgatacctgcaaaagacatggctaaagttatgattgtcatgttggcaatttgttttcttacaaaatcggatgggaaatctgttaagaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtgaaaatgaaaacagatattgtcagagttctgctctagacagtgtagggcaacaatacatgctgctaattcaaagctctattaagatttccaagtgccaatatttctgatataacaaactacatgtaatccatcactagccatgataactgcaattttaattgattattctgattccacttttattcatttgagttattttaattatcttttctattgtttattctttttaaagtatgttattgcataatttataaaagaataaaattgcacttttaaacctctcttctaccttaaaatgtaaaacaaa

SEQ ID NO: 571 - DNA, 705 bp, Homo sapiens
tgagtgcgtcctggcgagtctcagcccccaagcgggtggaacgcaccaagggtctcatccgcgaggaagggctttaacgctcagggtcaggaacctctgagagctcttggggacttgcgcgcccttggatgctcttgcgttcaacagggctaggagactaccggctggggcgaggaatgcaggcgcctagagccttggagctcctgaaacgttcctgccgcctccggaaagcaagggcagtttaccgaagtgactgagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacag

SEQ ID NO: 572 - DNA, 675 bp, Homo sapiens
gcggccgccgcggctgcggccgtggcaaagaaacaggctgcgggcggcaggaagggctgctggggctgcggctggggctgctggccggcgccgccgctctccatcttggcagagctttccatgcgcagcggcggccaaggagtcgcggaatcagagcgatccgggacgcgagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctc

SEQ ID NO: 573 - DNA, 4122 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaacgcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctctattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaatttcactgtttcagttatttcctggaatgaaatattcctctcactgccttagaaatacattagctagatagttttgtaacatgagaaaatggccagaggctcatatctccaaccctttgcaggggctccttgtgacactcaaagtcatgcctggacagtcaacggactttgacttttgttgattgtgtgtttgccatgaaaacatgaatatctgagaagcagtggggagaaaaaaaacaatatctttgtagctatgatttgaaattctcatactactttacattttattttggaaatagttaagtcttaaagaatttgcatagtgtttctttgagtttagttctcagaacagctgtagtatcatcaacagcaaattctgggtaccttcccagctccacccaatttgaatctctgaagataaggcccagagacctgtatttttaagtaccccatttttttaattattcatagccaaattctatcaggtacattcagtttgagaaaacctgatttgtggtggtcagtctgccactgccaatgatgtcaatgtggataagctgtttcccttctttagacctcagtgtcactctaacaatgagggagttaaactttataaaccaaggtccattgcagccttgaaatatgattcaagtgttcatatgtgtctttatatagctatgcctgatccactgatggggtgttacaatacctgcttatatatgccagctgggaggaaagaggaatttactgaatgtgtctgaagtttcattgttttgaagttggaattttatgcctgtatctatgtttatgcctttgtaaaacccactgattttaaaagtgaaaaaggacttttttctctgcttttactctaaacaccaaacaatccctgcaaagggattattctgatgtttcttcatttcacatgaaaagttaattattgactctggaacttaaatattagataatatttttgacaatattgaagagtgagttttagtccagtaaagatgttttaatgagcttgaaggtaaagtttcggttaagttatgattttcacaggaagttacatactgaatgaaagataatatttgtatttttggtaatgtgctactcagttcttagctcttttttatccagatataaaagcccagtctatagctatgggatttaataaatttccaatatgtaagtgtttttatttgtttaatttctagtaaatgagcaatattttagaaacagtatcagtctttactgacagatgatcttgctgagtacaatcaaaataaatacataaaaaattctaagcatgtggcattgatgtttaataagtttctgaaagtaggaatctgaattttaactgtaggtttctaagttatataatttagttgtgtttcaaaaaatccaccaataaaatgtcagctttataaaaacagaaa

SEQ ID NO: 574 - DNA, 3829 bp, Homo sapiens
cggcattgctgacaggcggccccgggggcggtggccaaggcggcgaccggagcgcgatggcgggggcggcgggactcacggcagaagtgagctggaaggtcttggagcgaagagctcggaccaagcgctcagttttaaaattgctatagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaa

SEQ ID NO: 575 - DNA, 5532 bp, Homo sapiens
agccgagcgccgactcacgccccagccccaattgggcggccggtttccaattggaagggcttctgagcctcagtcttcgggcggcgctgaccattggcgggcaggatggaggcggagccttgggttgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccagggagaacaggtgtcctgtgtctgtctggcttgggcaggaaagcccagaaggtgctcagcagggtgcagggatggtgccattctggcccagacctttattggggaaaatgttgggggtcacttggtcttgctcttgcctttacccggaggtagctggaagggccgctctagtgcagtcaacttgctgctgagcctttcctcgctggccttgagccgctcctccaccagcccctggagctgctccagctctttgttcacttgggtcttgatgtaggctcggaggacgtggatgtggcctgcaggggcagggaagaaggggcagggtgaggagagatgctgtctggcaatggggggatggtccctagttgggcaaacagtccccaaatttcccctggtggggatatagaggtagcaatgttgtttccctttaggaaatgttagcaagcccttgtgtgagaggtagttgggtagggtggctatgctggactttgcagcttcaaattctgatccctactcagtagctgtgtgaccttaggcaggttatttaacctatctgtgcctcagtttccttgtatgaaatgtggatagtgatacctagcacataggattgagggaggattaaatgagttaatttatgtaaaatgcttagagcagggcatgcactgcacacctattgccaagtatgtgctggctgttattgtcattggctttctctttttttttttttttttgagatggagtcttgctttatcccccaggctggagtgcagtggcagcgatctcagctcactgcaagctctgcctcccaggttcatgccattctcctgcctcagcctcccagtagctgggactacaggcacccgccaccacgcccggctaactttttgtatttttagtagagacggggtttcacagtgttagccaggatggactcgatctcctgacctcgtgatccgcctgcctcagcctcccaaagtgctgggattacagttgtgagccactgcacctggcctgttctttgtttttttttaactcttaagttctgggatacgagcagaacatgcaggtttgctacgtaggtatacatgggccatggtggtttgctttacccatcaacccatcatataggttttaagccaccgtcattggctttctaatgatcatttctctggagccacttcagctgtgctttttgtttgtttgtttgtttgttttgagacagagtcttgctctgttgcccaggctggagtgcagtggccagatcttggctcactgcagtctccacctcctgggttcatgcagttctcctgcctcagcctcctgagtagctgggactacaagcgcgcaccaccatgcctggctattttttgtattttagtagatagggggtttcacggtgttgcccaggctggtcgcgaactcctgagctcaggcaatccgcctgcctcagattgtgctgggattacaggtgtgagccaccacgcctggcctgcagctgtgcttttatctgtcatcttggacttctgcataagggatcatttagagaaaggactctgactaaaaacaaaaagtctgaagtcctgatgtcatccaaacccttcattctacacctgctcagagggacagggcagcctgccctctccagatcctcacttggctctggctctggtggggccactgtctctagttcctctttctgcggggtaactgcctgctcctccatctccttgctttcttctttctctgcaaaccagaagcaggaagagactgtggccccaggcctggcccagcccagccctgccctggcactctcccttacccgtctcactctctggccacagtttgggtggctgtagccccatgtaagtcaaagacagatccagccgcacctgggaagcaaggcagagggaggctgaaaggagtgcacctgtgctgaggggaggggcggttgagggtggctcctcatggtccaccaccccctacctggggtgtgaagacgtatttatagagcttgaagtggcggaagtaagtgttgaccacgtagtcttccaaggccagcagctgttcctctttgaagaggtcgatgctgaaaggaggccgctgtggtggtgactcggaattagaaccctgactaccttccggagccctggctttgcctccaaaagcccagcaacaggagcaaggagagcccactggggtcttcacaagaagataagggtgatgaatgtgagagagactgggtgagaccttgtctggggatgggtaaagtttccagaatgttccaggggaactgaccctgactccatggcaaaaaaggacactggtgaagtagcggtagcactcctccacgttgcccaagggggttgctggtagggaaagcaagatgcagcagtgaggccctctctggtatccattcattcacttcactcaacagctgtttatgaccatgagcttcagaagcagacagatctgggtttcagcactggcttgtttccttaactcatgtaacaaatactgaatacccactatatgcccactgtatggttttcggcactgaacaagacagacaaggtcctgcccttacgaagcttatattctaggggaataaaccaagaaatagatcatttcagctattaaacattctgaagcaagagctattaaacattctaaagcaggtgttattgtgcactatgcatatatttgcatatattatttctcagaacagtcctgtaaaatgtgtgctgtatccttaatttctagataaggaagcagtggattggaaagctgatggcttgtgtatgatgatgctactaataatgacatattccaggcagaaatcccctgcttctgcttcccatggtcacttgtgccaggcccggttcctcttctccctggggctcaaacctggtagctgccccctctcaccaatacaagccttgtgaagatcctggagcagggcacaagccgctgacgtctgctccagtgagaagccctgctggcggcagaaaatgagcgcgtggcagaagaggtccagggtgatggcgtccctcaggctctgctcaggacaccctagctccagcagctcagccagcacccttgggagggagagaggagtgagtgacaactgggcctcctttcatcaccctacacccaccacatgctttggagtcagccattcctcatgttttcccaacctgacccctcagcctttgccaagagctcttcccacgcccccctcagtccctactccctcatctcagcattggtggtcttctccagctggtgcatggaatggacgtccaggtacttcctgttatagtaaaagaaaaagagtattggtggccgttacctatcatgacaaggctgtgacagctagtgcgtgagactgggagttggccaccggcgtgaagctgggctcttttgccagcttgctgtgtgactatgcaaatcgttaactctctgggcctaaatgaactcttatgagcctctccatttctaaagcctagggttaggaatcttgaattcttttttctgctctgccactaccttgtatgaccttggtcaagtactccctgtggccctcagtgtccccctctgtacaatactccttagcggccatgagactccatttacattctgtctttggctctttttttctcacactgcctcctctttggactggagaggctggaaagccaacttccagtcacctggagtaattgcatctccaggcctcagtctcatctgtaaaatggggatgccctggccacagacaggactgttggggagacaataaagaacgcaaatattc

SEQ ID NO: 576 - DNA, 5559 bp, Homo sapiens
cggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgct

SEQ ID NO: 577 - DNA, 5603 bp, Homo sapiens
attgctgacaggcggccccgggggcggtggccaaggcggcgaccggagcgcgatggcgggggcggcgggactcacggcagaagtgagctggaaggtcttggagcgaagagctcggaccaagcgctcagttttaaaattgctatagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacgtaagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcaccttta

SEQ ID NO: 578 - DNA, 5463 bp, Homo sapiens
ggccaaggcggcgaccggagcgcgatggcgggggcggcgggactcacggcagaagtgagctggaaggtcttggagcgaagagctcggaccaagcgctcaggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggttggcggtgcgctacggggctgcatttacccagaaattttcttcctctatagccccacacattactacttttctggtacatgggaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacgtaagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcaccttta

SEQ ID NO: 579 - DNA, 5603 bp, Homo sapiens
attgctgacaggcggccccgggggcggtggccaaggcggcgaccggagcgcgatggcgggggcggcgggactcacggcagaagtgagctggaaggtcttggagcgaagagctcggaccaagcgctcagttttaaaattgctatagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggttggcggtgcgctacggggctgcatttacccagaaattttcttcctctatagccccacacattactacttttctggtacatgggaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacgtaagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcaccttta

SEQ ID NO: 580 - DNA, 1728 bp, Homo sapiens
agccgagcgccgactcacgccccagccccaattgggcggccggtttccaattggaagggcttctgagcctcagtcttcgggcggcgctgaccattggcgggcaggatggaggcggagccttgggttgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccagggagaa

SEQ ID NO: 581 - DNA, 2349 bp, Homo sapiens
aattgggcggccggtttccaattggaagggcttctgagcctcagtcttcgggcggcgctgaccattggcgggcaggatggaggcggagccttgggttgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactggataaggaagcagtggattggaaagctgatggcttgtgtatgatgatgctactaataatgacatattccaggcagaaatcccctgcttctgcttcccatggtcacttgtgccaggcccggttcctcttctccctggggctcaaacctggtagctgccccctctcaccaatacaagccttgtgaagatcctggagcagggcacaagccgctgacgtctgctccagtgagaagccctgctggcggcagaaaatgagcgcgtggcagaagaggtccagggtgatggcgtccctcaggctctgctcaggacaccctagctccagcagctcagccagcacccttgggagggagagaggagtgagtgacaactgggcctcctttcatcaccctacacccaccacatgctttggagtcagccattcctcatgttttcccaacctgacccctcagcctttgccaagagctcttcccacgcccccctcagtccctactccctcatctcagcattggtggtcttctccagctggtgcatggaatggacgtccaggtacttcctgttatagtaaaagaaaaagagtattggtggccgttacctatcatgacaaggctgtgacagctagtgcgtgagactgggagttggccaccggcgtgaagctgggctcttttgccagcttgctgtgtgactatgcaaatcgttaactctctgggcctaaatgaactcttatgagcctctccatttctaaagcctagggttaggaatcttgaattcttttttctgctctgccactaccttgtatgaccttggtcaagtactccctgtggccctcagtgtccccctctgtacaatactccttagcggccatgagactccatttacattctgtctttggctctttttttctcacactgcctcctctttggactggagaggctggaaagccaacttccagtcacctggagtaattgcatctccaggcctcagtctcatctgtaaaatggggatgccctggccacagacaggactgttggggagacaataaagaacgcaaatattcagtgt

SEQ ID NO: 582 - DNA, 3048 bp, Homo sapiens
ggaaatccggaagggagcctccgagcccaggtcccgggctggcaggggtctcgccggcgcttggacctcgtctcccacccccgagcccactgcggccccagagcctcgggaggggccgggcacttcctctgccctccggcctggggcaggggccgggacgcggtgggagtgcagcggggacggcaccgcccgagggggcgggccccaaactttcgtgcgcgttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagg

SEQ ID NO: 583 - DNA, 2743 bp, Homo sapiens
aaactttcgtgcgcgttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggct

SEQ ID NO: 584 - DNA, 2741 bp, Homo sapiens
atgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctggaacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggtttt

SEQ ID NO: 585 - DNA, 4618 bp, Homo sapiens
cttagagactgcttgttgggttccatcctcattgctctgagactcttgttgggagtatgaggcttggatcaggggaaggggagttgacattagttcttaaagaattggaataacaaatccatgggtatttctgaaaaaaaaaaaaaaaaaaagaaaggaagctacttggaattgtcccatatttaacattctgctgaccaatcaatttgtcctagttacagaaaaccaccctggacttctcctatgcatttgggcttctcctagggacaccaagagggaggaaggaggggttaggatggtatgaaagattctacttggccaatattattgtaatgcggcattgtgatctctggatttagcatgagttgatagctgactttttctgcagaagcatcttggtggcacctctaactcaaagtccctcgatggagtcagttccagttctccacttctggccccatctggtacacaccactgcctctcactgcccgggctctctatccttgacaggctgccttgaagttgagcccagactgattttcttgcctcagaccccactaccgtgcctgggactcatgcacctttgactcccatggaagggaagtgcagtagtttcccaggtgcaattctggtgtcctcacccacattgaggatgtacaagaatcaggttcttagagattggagaaagaaggaagaatgggaacaagatttttcccaaaggactgtgaggtcccccacctaaccttgatgtgagacaagtgaggttaaccccaagcctggtgagaagcgttcccatcagacacttggaaatcctgaggactgtttcatgcagaaggatatggtttattcaggtttgactcgtgcttgagaaagctagagcctctggtggtgaatgattttaataactatttcctttccaccaacatatacagtacaaataataataagcaaaaataaatagaaacattcagttttgttttgaatagtaggagcagggtaccatcatttctgtagttactcttttagtacaacgatgcatgtctactgtatgtaaggcatactagcagaaattgagctcagcactagagaagatgattgcattctatgccttgcttctttttttaaaaaaaggcttccatagatagattctcagaacagcccatggcaaatgtaaagttatttggaaaacccaggttccagattcactagagcatagaatctctggttggttgggaaggaatttcctcttacagttgttactaataattgtatgaacaattatttaaaatattaacatttacatttgtgaagaccttgaagggctggagacaacagagaagcatttttgaataccctctgcagcccctgcactgttgtaggcattggtggatggtaccaaagatgggacactgtccctacctccagagaccctgtgggctggctacagagagaaggcagggaggaggaaaagaagaataaagtcatatgtttaagtcacccccacggccgttggttagtcatgggaggctccccagaggagctgtcctgaagctggctgacagaaggcaacatttcaacttaggacagtaatccttgctacatacaatcacatacacacacacacacacgtgcacacacagagactcacatggaaaaataaacctttgtgcctttcagcagtgatgacaattatggttttcagtaaactttacatggtttagatggtgatggtgatgatgatgattatgggaaggatggcatcatgttctaaacatactgcatggagtcagaataacaatgacaaataaccatttgtcccaatcaaggttttctcagaaaatatctcattctgatgctaaactataccagtctgtttgatcacttctccaacaaaataattacaaagtgcttatattttcttgaaaagagagggtcctgtgttgtctactaccacttttgaaacttagagaaaatgttccaaaagatgatgattttactatttagttcggcctttaagatgtcaaaaactcagtgcttggaatttgtctcgaattacaccacaaaattgctaccttgtctcaaatgggatttctttcccaccttgtgccacagcggccccttcatttgattgtgggaagcctcaagtggagccgaagaaatgtcctggaagggttgtaggggggtgtgtggcccacccacattcctggccctggcaagtcagtcttagaacaaggtaagaacaggcccagaaacgatttatactgtccctccacgtaagccctgcaaaacccttctacatttacataaaatccacacagctgaggcatcagcacctgcctctaagttttctgaaggaggaaaaaagctacaaaaattaatatatgtatatatacatatatatttttataggttctctactgtgaaaatgacaaaaattgctgtctttttcttgatctgggcagctccatcaaaatctgtaggcacagtgatttgcaccaagttccaatattgctggaaaatactgaagatgctctgaggatttctatggatatccattgtctcattgtcagatgaaaagagggggaagtttttagaaatgtgacactttctgggttgggagagcaaggacaaaattatctccagtctatcacaggcacagattctttttctttggacactttcgtgaatcattgaattcaatgcagaggctactcatccattcgcaaacaaaaaaattctaggtcatgatccccataaatgaagagtgatcagtccaatcccagggaacctggacattttgggtattgtttcagtggaacatgcctttcataagttccattttcttgggtatctcttaggaagcaagcataggaaacaggcccatccgtctgcctgttttgcttcctcatctcacttctacacgagggtgcctgtgctcaattgctgttttcccctaaagagactcttttccataagtttgtgaaatgccatcgacaaacctgatcgcattgcatttcactctgctgttgagtcgatttttctttattttatcatttagtaactccttgctctacagagctttcaccttccacatatttcagattcattctttcctaaactatgtggtggtctacgtcctcactgacttatcaacatgctaccatcatgcacttcctatctctattcctcttctttaaatttggttccaaatggctcacaccattattctgagctattacctgcctacgcagtcctagaaagtaagtgattcaggaaacattccccaaaagtaaagtttctcaggtaagatcagaagactcccatgagtcactgctgctcaggatcacatctggctccttgaagagtgattcatcagaccttacatagatcttgtcataaaaatgaaagaggcctcgggggaaggtcttgggctggtggcttctgttggagtcctgggctgtggggtgaaagccgtggctgtagagcttcatgcggagttacttagctttgctctcctgtggacaggccatgcctgtgcctcccccaagcatcggaaaaattggcatagatgggcccttctcaaaaatcccactcctggagcactggccaaaattactaccatcctgatgctgggcttgcagtcctttcctttgggaatatgaacatggtcaaaattaagtgaacgtgtctttctggctttctgtacaatggagcagaacaaagtatcaatttaactaaaatttgaactaaatcctctttccaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctggaacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttg

SEQ ID NO: 586 - DNA, 1166 bp, Homo sapiens
tctcatgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctaggtaagacattccctttcatctttgtgttcatctactgtaaagttgtccctctgtgtctgtgagggattggttccaggacccctgtggctaccaaaatccatgcttctcaagtcccttatataaaatggtgcagtatttgcatataacctacataccttctcttgtataatccctaatataatgtaaatgctatttaatcgttgttatactgtattgtttttatttgtattatgttttattgtcatattgttattttctgtcatctttttcaagtcttttccatccacagttggttgaatttgtggatctggaacccatggatacagagggccaactgtatttaggataatttcatcacttttaattcaaaccacaatatgtgaataagcagatagaaagaatctttttgatgtcgatgttcaactatttttggcaccatagtagaacatggttgctttctattttttcttggatatggaggtttcttgaagacctagaacatagaagaatgcctagtttaaaaaaaatcaatgaaactatgagttttaggccaaatctgagaaaagatcaaagatgactatgtttgggactgaagtaagcatatcaggttagaactctcatcacatgttcgactcaaattgtggagcaaaagagtaaataagatataaaaatgaaaatgaagatacgtgaaa

SEQ ID NO: 587 - DNA, 2706 bp, Homo sapiens
gaacttcctccccctgctttataaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaa

SEQ ID NO: 588 - DNA, 2665 bp, Homo sapiens
atggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccgctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaatcagagtggaatggttttgttatagatgctgtatcccactctttattcatgttcacattttaaaatcatttggaattctgcttcactcgcttaacatatacacaacacctgtaacatacaaggcaatgggctaggtgctccagaccgggaaaaggagggacaggaatgcttggtctgatgggctaatatggcatttagagaagtaccaaggtacagtggagccggtcacaaaagggcagacttgtagtagaattcagttgcaagagggattggggaatcttaaggaaaaaatagaatcttaaggaaaaaataactgggtgagacgtggactgtggacaggtgtggaaaaggcactctccatggaggtatgaatatgtagagggccaagagaggggagtacagggagaaatgagttgagcttgtctgaagtgaacttcaggaagaggaacataggctggaatttagattatgggggctctgaacaccaaactgagtttggacttaattgacttctg

SEQ ID NO: 589 - DNA, 2516 bp, Homo sapiens
atggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 590 - DNA, 2599 bp, Homo sapiens
agagctgagatcctacaggagtccagggctggagagaaaacctctgcgaggaaagggaaggagcaagccgtgggagggagagaggaagggagggagggaagacgaaaacacgccgaggtcccagaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaa

SEQ ID NO: 591 - DNA, 1655 bp, Homo sapiens
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctct

SEQ ID NO: 592 - DNA, 2030 bp, Homo sapiens
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtata

SEQ ID NO: 593 - DNA, 670 bp, Homo sapiens
aaaaaaaaaaaaggacatgctacagcatggatgcaccttgaagacatttgcaaagtgaaacaaaccagtcgcaaaagaagaaacactgtctcattccacttctaggataatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactg

SEQ ID NO: 594 - DNA, 549 bp, Homo sapiens
agttttgagaaacaggaaatttgaggaaagctgagaaagagaagatctggaaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggccc

SEQ ID NO: 595 - DNA, 1613 bp, Homo sapiens
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaataggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttct

SEQ ID NO: 596 - DNA, 3262 bp, Homo sapiens
ccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttatcttggtttgtccttcagttactgaggtagggatgggaatatccaatgctcatacccaagtgaccctgaaactaaggtgccatttacactccttaaggtcacacaacatcagagggagagctgggattgcagccaagtttatttgtacagggccctgtgataggctagttcccaaaagcctgtgatgcaagaacttttgcccatagactcagtcaccatgtagctgttacctgttcagagctggctttttgctttcccaccctactctggaattcttaaatggctttatacttagaaatcatcttatttctgttgaacctagatcaccccaaccagaaacttctattaatactttgtgctttcttgataccagggtctatttggtttccacttaaggtttttgcatactctgcccataagtgactcattagttactcaagttttattcctggctctgccactagttcattaggggtctttgccccagagtcatttcttccattttaaaaacttgggctcattaaatctaggtaggaaagggcgggtgtggcaggttttaatagaacaggtcaagataaggctttatttctatagaaatgatgctttgacaatagtttggcttggtgtaaggctcacaaaagaaaatcacatgtaccatgtgtgggttaagcggtttgattcacactgaaccaggccagcccagttgccctctgctgtgtccacccgtggagtggagctgtgtcacagccatcacactggtaaactgctgtagctggtttaccaggctttctcttgccctgacagtacaggtgaagcctgtaaataaatcttctgctatctttgtgaacttaaccaaatcccagttaccttatttaaatggcaatagatctgttttcccttaaactagaaaccttaattacctgtattcctacctccagctcaacccatatatttgcacctttccagtaagcaggtttgtatttccatctctccccttcccctaagattctgaattagttctccagaccttgccaagcacattctccctggaaagcaaggaatatcacagacccacaagaagagtaaatgcccaggagtgaatgaagcggcttgtccttgacttggaaataaaagcaaagctgtgaaaagccaggtcgctacgattttgttggcagcaggactagccacagagtagggaagttttggggccaggccctaggttttcccagaatgccttgggtgatgccaccaagaaccttaagaactccctcttacattttccatcggttgcaggcatggcttttgcaactgataggtgctctgactacagatattctggtgtccatggcaacatggccttatggcttgtaatagtgggaacttccagctcactggcaatttcctggaggtggcaatatctttggcaggaaaccatctcttctgtcttggccaccagggtctgctccaggccctgaatgagtccacatcaatccatccttcttccctgtagtcattccctcctggggagggaagggaaggggggtatttatcagacctatttgctcgctgctgtgtctactcatgggcaggtgtgtccgatggtgccttggcagtggaccttaggtctgaatgccagcccggcaccctgggcatcggaagtcggcctccctggcagcctggatgctgcagccaacacaggccacatggaaccagacgtcacagccatcacactgaacccaggccactgtctcttcctggggcaggcagcaacaaggagctgcacagggctccccgcccccaactgcagggggagccatgggagcgctcactgggtacttccgaggacggccacgtcgatttc

SEQ ID NO: 597 - DNA, 1163 bp, Homo sapiens
gtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactta

SEQ ID NO: 598 - DNA, 1420 bp, Homo sapiens
agagaggggttgagtagtcccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactta

SEQ ID NO: 599 - DNA, 1163 bp, Homo sapiens
gtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacactta

SEQ ID NO: 600 - DNA, 1163 bp, Homo sapiens; identical to SEQ ID NO: 599

SEQ ID NO: 601 - DNA, 1420 bp, Homo sapiens
agagaggggttgagtagtcccttcgcaagccctcatttcaccaggcccccggcttggggcgccttccttccccatggcgggacacctggcttcagatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggtgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacactta

SEQ ID NO: 602 - DNA, 1420 bp, Homo sapiens
agagaggggttgagtagtcccttcgcaagccctcatttcaccaggcccccggcttggggcgccttccttccccatggcgggacacctggcttcagattttgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacactta

SEQ ID NO: 603 - DNA, 1163 bp, Homo sapiens; identical to SEQ ID NO: 599

SEQ ID NO: 604 - DNA, 1420 bp, Homo sapiens; identical to SEQ ID NO: 601

SEQ ID NO: 605 - DNA, 911 bp, Homo sapiens
atggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggaggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttct

SEQ ID NO: 606 - DNA, 1163 bp, Homo sapiens; identical to SEQ ID NO: 599

SEQ ID NO: 607 - DNA, 1420 bp, Homo sapiens; identical to SEQ ID NO: 602

SEQ ID NO: 608 - DNA, 369 bp, Homo sapiens
atggcgggacacctggcttcagattttgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagactccgatggggcctccccggagccctgcaccgcatccatttcctttcccactcctg

SEQ ID NO: 609 - DNA, 1395 bp, Homo sapiens
ccttcgcaagccctcatttcaccaggcccccggcttggggcgccttccttccccatggcgggacacctggcttcagatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggtgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtgcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacactt

SEQ ID NO: 610 - DNA, 369 bp, Homo sapiens
atggcgggacacctggcttcagatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggtgaagcaggagtcggggtggagactccgatggggcctccccggagccctgcaccgcatccatttcctttcccactcctg

SEQ ID NO: 611 - DNA, 1395 bp, Homo sapiens
ccttcgcaagccctcatttcaccaggcccccggcttggggcgccttccttccccatggcgggacacctggcttcagattttgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtgcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacactt

SEQ ID NO: 612 - DNA, 369 bp, Homo sapiens; identical to SEQ ID NO: 608

SEQ ID NO: 613 - DNA, 1395 bp, Homo sapiens; identical to SEQ ID NO: 609

SEQ ID NO: 614 - DNA, 1395 bp, Homo sapiens
ccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtgcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactt

SEQ ID NO: 615 - DNA, 369 bp, Homo sapiens; identical to SEQ ID NO: 610

SEQ ID NO: 616 - DNA, 369 bp, Homo sapiens
atggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagactccgatggggcctccccggagccctgcaccgcatccatttcctttcccactcctg

SEQ ID NO: 617 - DNA, 3637 bp, Homo sapiens
agcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcctaa

SEQ ID NO: 618 - DNA, 1101 bp, Homo sapiens
aggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgcatatttggaggatcactgcgggggccacagaggtgctgttcagatggcacttcagaagactcaggagaccctggggcaggagcagtttgactgacagcccagagggctgccctctgattccacctgaggccctgcttttcctggctgcaggggttccagggccaggccatttccgctggcgcaggactctgctagcagcaacctgcctgaagtcttcctttggcctggctgagagtttctgagacctgcgctggagcggagacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctc

SEQ ID NO: 619 - DNA, 1541 bp, Homo sapiens
agtggggagcacggtggagagcggggacggccggctctttggggacttgctggggcgtgcggctgcgctattcagtgggaaggttcgcggggttgggagacccggaggccgaggaagggcgagcagagcactgccaggatatcctgcccagatttcccagtttctgcctcgccgcggcacagacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcct

SEQ ID NO: 620 - DNA, 1773 bp, Homo sapiens
aactcgaactccaggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaagcca

SEQ ID NO: 621 - DNA, 1586 bp, Homo sapiens
cgggggtaggcactgcccggagctcagaagtcctcctcagacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttgggggcgcggcaccagcaccagctgcccgcgccctcccctgcccgcagaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaat

SEQ ID NO: 622 - DNA, 1386 bp, Homo sapiens
atgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttag

SEQ ID NO: 623 - DNA, 598 bp, Homo sapiens
ctgcattctggagctgctttctaggcaggcagtgtgagctcagccccacgtagagcgggcagccgaggccttctgaggctatgtctctagcgaacaaggaccctcaatcccagcttccgccctgacggccagcacacagggacagccctttcattccgcttccacctgggggtgcaggcagagcagcagcgggggtaggcactgcccggagctcagaagtcctcctcagacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggc

SEQ ID NO: 624 - DNA, 581 bp, Homo sapiens
actcgaactccaggctgtcatggcggcaggacggcgaacttgcagtatctccacgacccgcccctcttccgccctgacggccagcacacagggacagccctttcattccgcttccacctgggggtgcaggcagagcagcagcgggggtaggcactgcccggagctcagaagtcctcctcagacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctggg

SEQ ID NO: 625 - DNA, 1853 bp, Homo sapiens
aggctgtcatggcggcaggacggcgaacttgcagtatctccacgacccgcccctgtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttgggggcgcggcaccagcaccagctgcccgcgccctcccctgcccgcagaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacg

SEQ ID NO: 626 - DNA, 1828 bp, Homo sapiens
aactcgaactccaggctgtcatggcggcaggacggcgaacttgcagtatctccacgacccgcccctgtgccagtgcctccagaatgtggcagctcacaagcctcctgctgttcgtggccacctggggaatttccggcacaccagctcctcttggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcggggcggggcggggctggggccgggttgggggcgcggcaccagcaccagctgcccgcgccctcccctgcccgcagaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacg

SEQ ID NO: 627 - DNA, 889 bp, Homo sapiens
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcaggtgattttattcaaacagtctcactgggaatctcaccggacggagggaaagcactgagaacaggaagctgcttcacccgagagttccttggtgccctttccaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacatttttttgctg

SEQ ID NO: 628 - DNA, 1177 bp, Homo sapiens
tcaaatttgtttctgtgtgtgtaaaaggaaaggcttcatatctaaaatgactttacctcagtatactaaattgtttgagggtaatgaatgagaagaacacaactgtaaaagggccaaggacagagggatgggcaaatgaaggaaaggcagagagggagaccaagagctgagggggaaaattctgtggaggggtgtgggaaaggggtggagctggcacccttgccttaaaagctgagtgatagcccaagggatacaaaagaccgcttgagccgggtagggaaagcagcctaaagcccgggacaggcacacaggcccaggtgtgtaggccacagcagctgcagtcctgaaaggctgcaacgtcccgacctccaggagagaccaggcccaggatgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacatttttttgctg

SEQ ID NO: 629 - DNA, 2592 bp, Homo sapiens
gagtcatccagctggagccctgagtggctgagctcaggccttcgcagcattcttgggtgggagcagccacgggtcagccacaagggccacagccatgaatggcacagaaggccctaacttctacgtgcccttctccaatgcgacgggtgtggtacgcagccccttcgagtacccacagtactacctggctgagccatggcagttctccatgctggccgcctacatgtttctgctgatcgtgctgggcttccccatcaacttcctcacgctctacgtcaccgtccagcacaagaagctgcgcacgcctctcaactacatcctgctcaacctagccgtggctgacctcttcatggtcctaggtggcttcaccagcaccctctacacctctctgcatggatacttcgtcttcgggcccacaggatgcaatttggagggcttctttgccaccctgggcggtgaaattgccctgtggtccttggtggtcctggccatcgagcggtacgtggtggtgtgtaagcccatgagcaacttccgcttcggggagaaccatgccatcatgggcgttgccttcacctgggtcatggcgctggcctgcgccgcacccccactcgccggctggtccaggtacatccccgagggcctgcagtgctcgtgtggaatcgactactacacgctcaagccggaggtcaacaacgagtcttttgtcatctacatgttcgtggtccacttcaccatccccatgattatcatctttttctgctatgggcagctcgtcttcaccgtcaaggaggccgctgcccagcagcaggagtcagccaccacacagaaggcagagaaggaggtcacccgcatggtcatcatcatggtcatcgctttcctgatctgctgggtgccctacgccagcgtggcattctacatcttcacccaccagggctccaacttcggtcccatcttcatgaccatcccagcgttctttgccaagagcgccgccatctacaaccctgtcatctatatcatgatgaacaagcagttccggaactgcatgctcaccaccatctgctgcggcaagaacccactgggtgacgatgaggcctctgctaccgtgtccaagacggagacgagccaggtggccccggcctaagacctgcctaggactctgtggccgactataggcgtctcccatcccctacaccttcccccagccacagccatcccaccaggagcagcgcctgtgcagaatgaacgaagtcacataggctccttaattttttttttttttttaagaaataattaatgaggctcctcactcacctgggacagcctgagaagggacatccaccaagacctactgatctggagtcccacgttccccaaggccagcgggatgtgtgcccctcctcctcccaactcatctttcaggaacacgaggattcttgctttctggaaaagtgtcccagcttagggataagtgtctagcacagaatggggcacacagtaggtgcttaataaatgctggatggatgcaggaaggaatggaggaatgaatgggaagggagaacatatctatcctctcagaccctcgcagcagcagcaactcatacttggctaatgatatggagcagttgtttttccctccctgggcctcactttcttctcctataaaatggaaatcccagatccctggtcctgccgacacgcagctactgagaagaccaaaagaggtgtgtgtgtgtctatgtgtgtgtttcagcactttgtaaatagcaagaagctgtacagattctagttaatgttgtgaataacatcaattaatgtaactagttaattactatgattatcacctcctgatagtgaacattttgagattgggcattcagatgatggggtttcacccaaccttggggcaggtttttaaaaattagctaggcatcaaggccagaccagggctgggggttgggctgtaggcagggacagtcacaggaatgcagaatgcagtcatcagacctgaaaaaacaacactgggggagggggacggtgaaggccaagttcccaatgagggtgagattgggcctggggtctcacccctagtgtggggccccaggtcccgtgcctccccttcccaatgtggcctatggagagacaggcctttctctcagcctctggaagccacctgctcttttgctctagcacctgggtcccagcatctagagcatggagcctctagaagccatgctcacccgcccacatttaattaacagctgagtccctgatgtcatccttatctcgaagagcttagaaacaaagagtgggaaattccactgggcctaccttccttggggatgttcatgggccccagtttccagtttcccttgccagacaagcccatcttcagcagttgctagtccattctccattctggagaatctgctccaaaaagctggccacatctctgaggtgtcagaattaagctgcctcagtaactgctcccccttctccatataagcaaagccagaagctctagctttacccagctctgcctggagactaaggcaaattgggccattaaaagctcagctcctatgttggtattaa

SEQ ID NO: 630 - DNA, 3236 bp, Homo sapiens
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 631 - DNA, 1622 bp, Homo sapiens
aggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaa

SEQ ID NO: 632 - DNA, 1885 bp, Homo sapiens
gtgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcgcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagc

SEQ ID NO: 633 - DNA, 1450 bp, Homo sapiens
ggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggtgagatcaccctgacgaccttgttgcaccctggtatctgtagggaagaatgtgtgggggctgcagctctgtcctgaggctgaggaaggggccgagggaaacaaatgaagacccaggctgagctcctgaagatgcccgtgattcactgacacgggacgtggtcaaacagcaaagccaggcaggggactgctgtgcagctggcactttcggggcctcccttgaggttgtgtcactgaccctgaatttcaactttgcccaagaccttctagacattgggccttgatttatccatactgacacagaaaggtttgggctaagttgtttcaaaggaatttctgactccttcgatct

SEQ ID NO: 634 - DNA, 1628 bp, Homo sapiens
atgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaa

SEQ ID NO: 635 - DNA, 3340 bp, Homo sapiens
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 636 - DNA, 3144 bp, Homo sapiens
tcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 637 - DNA, 3532 bp, Homo sapiens
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 638 - DNA, 1559 bp, Homo sapiens
cacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataa

SEQ ID NO: 639 - DNA, 581 bp, Homo sapiens
aaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaa

SEQ ID NO: 640 - DNA, 643 bp, Homo sapiens
caggcaccaccactgacctgggacagtgaatctgttactgatgtcggcaagtacttggcacaggctggtttaataatccctaggcacttccacgtggtgtcaatccctgatcactgggagtcatcatgtgccttgactcggggcctggcccccccatctctgtcttgcaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggagg

SEQ ID NO: 641 - DNA, 571 bp, Homo sapiens
agagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccat

SEQ ID NO: 642 - DNA, 583 bp, Homo sapiens
agagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccc

SEQ ID NO: 643 - DNA, 951 bp, Homo sapiens
actgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcag

SEQ ID NO: 644 - DNA, 958 bp, Homo sapiens
ggaacctctgcgagatttagaggaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctc

SEQ ID NO: 645 - DNA, 1594 bp, Homo sapiens
tctgccccaccctgtcctctggaacctctgcgagatttagaggaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtagagaaggaactcaccccagaggtgctgcaagagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctca

SEQ ID NO: 646 - DNA, 2284 bp, Homo sapiens
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 647 - DNA, 2263 bp, Homo sapiens
gggacttgaaaaactggagcctgttcttggcaagaagattctaatgcccaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggcc

SEQ ID NO: 648 - DNA, 2092 bp, Homo sapiens
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggtacaaccaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 649 - DNA, 842 bp, Homo sapiens
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttc

SEQ ID NO: 650 - DNA, 2002 bp, Homo sapiens
aagaagaccaagcggtcagtcccattccgtcccatcctgatttacaggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgactttc

SEQ ID NO: 651 - DNA, 1733 bp, Homo sapiens
ctgcactggagctgcctggtgaccagaagtttggagtccgctgacgtcgccgcccagatggcctccaggctgaccctgctgaccctcctgctgctgctgctggctgggtttcttgaaccacaggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctg

SEQ ID NO: 652 - DNA, 1751 bp, Homo sapiens
gcactggagctgcctggtgaccagaagtttggagatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatg

SEQ ID NO: 653 - DNA, 648 bp, Homo sapiens
atgctgtttttattgttactcatgaagacgcgggggaagctttggttgtgtaaagctgagaactgcacccaagcttccccgttcaccccacctaccaggggatttgggctaaattcctggcctggcccacaaagaagaccaagcggtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatga

SEQ ID NO: 654 - DNA, 634 bp, Homo sapiens
atggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctga

SEQ ID NO: 655 - DNA, 4094 bp, Homo sapiens
gtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaactta

SEQ ID NO: 656 - DNA, 3333 bp, Homo sapiens
cacttactaaatggaatttaataaaaacactgtcaaaagttgggaggaccaaaattgatactttttctctgatctttttgccatgtgtatatctgaattctttgtttttaaagaagaaacagcattgaagcattatttggggggaaaaacacacacacaaaatccagcaactcagcattcatgagcaactctatactataccagtatgtgcctgtgcagtggaaggaaaacaattttggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaa

SEQ ID NO: 657 - DNA, 3295 bp, Homo sapiens
cagatcctcaagcgatgtttgatattgaatatttcagaaaagatccaagaccattcttcaagtttgcaaagaagaaacagcattgaagcattatttggggggaaaaacacacacacaaaatccagcaactcagcattcatgagcaactctatactataccagtatgtgcctgtgcagtggaaggaaaacaattttggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaactta

SEQ ID NO: 658 - DNA, 3587 bp, Homo sapiens
gcatctcctcctccctctccccgggctcctactggcctgaggttgagggcggctgggggctcggggcaggctccgcggcgttcccctccccaccccggccctccgttcagccgcgctcctccggggctgcggttcctactgcgcgagctgccagtggattcgctcttttcctccgtccgtggcccgcctgggcggccttgttctttccgcagcagccagataaccttctgttcggtgatgaaattatcactaatggttttcattcctgtgaaagtgatgaggaggatagagcctcacatgcaagctctagtgactggactccaaggccacggataggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaactt

SEQ ID NO: 659 - DNA, 1497 bp, Homo sapiens
aggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccagtgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacaggtgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgc

SEQ ID NO: 660 - DNA, 1636 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccagtgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacaggtgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 661 - DNA, 1473 bp, Homo sapiens
ttattgttcccgtggggcagtcgaggatgtcggtgaattacgcggcggggctgtcgccgtacgcggacaagggcaagtgcggcctcccggaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacaggtgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgc

SEQ ID NO: 662 - DNA, 3210 bp, Homo sapiens
aataaacaggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttc

SEQ ID NO: 663 - DNA, 1533 bp, Homo sapiens
aggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattacca

SEQ ID NO: 664 - DNA, 2811 bp, Homo sapiens
ctattcgggctcccgcctctgttcagttccagagacaattcatgggtcttggggccaccgaggcgctgtccctgaccaccagcacgagacccctttctatcgcgccagtcctgtggtctccgcacctctccagctcctgcacccccggcccccgtggttcccagccgcacagtagcgtgtcctgggtagcgtgaggacccacggggctgggcaggtgccacgagcccgccgcctcttcgccgcccgccgcctctcctcctctcccgcccgccgcctggccctcccctaccaggctgagcctctgggtgccagaagcgcggggcctccgggagaatacgtgcggtcgcccgctccgcgtgcgcctacgccttctgctccagttgctttcccaattgagcggaaaagccggggcatgttgccggggccctgggcgggacggttgtgccctgcagcccgaagcccgccggggcaccttcccgcccacgagctgcccagtccctctgcttgcggcccctgccaacgtcccacaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttggggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgtgtggttgtctccttcctctgtctcctgctcatccacaatgaacctgctgatgttggactccgcaacctggaccccatgccctctgagggcaagaagggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaacactgtcagtgattcattttttcaaagtgagacagcttccttgggaaatattgtcaatacctgctctttccaccccaaaatggaaagacttcatttccctggaatggggaagctgaagtgtagatggactcctttaaaactcatgcctcctctgccttcacctgaacattgaatagttcaatgattattttagagataaagctattgggttgtggacagattaaataacttgatggaggg

SEQ ID NO: 665 - DNA, 1779 bp, Homo sapiens
agccccgccccgtcctattcgggctcccgcctctgttcagttccagagacaattcatgggtcttggggccaccgaggcgctgtccctgaccaccagcacgagacccctttctatcgcgccagtcctgtggtctccgcacctctccagctcctgcacccccggcccccgtggttcccagccgcacagtagcgtgtcctgggtagcgtgaggacccacggggctgggcaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttggggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgtgtggttgtctccttcctctgtctcctgctcatccacaatgaacctgctgatgttggactccgcaacctggaccccatgccctctgagggcaagaagggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaaggatgttgctttctggactctggctcttcaccctctcgcggagctcacaggctttacagagcatgagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtga

SEQ ID NO: 666 - DNA, 3442 bp, Homo sapiens
gggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgttctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaatttttcctgaa

SEQ ID NO: 667 - DNA, 824 bp, Homo sapiens
aatgagagccagcattcataagaaacttcgcaagagcagtggaatagtgaccattctttattctgcctttgtcctggtgagcacatctgatatggcagaggaaactgaggatgcctggccgaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccc

SEQ ID NO: 668 - DNA, 299 bp, Homo sapiens
atactcatgcgtggctcccttcactactgggtgtcagtctggcctgtgctcaaggtgtggcatctggttggagtttcaatatgtaggatccactaccagggttttcgtgagattaagaaggaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaat

SEQ ID NO: 669 - DNA, 209 bp, Homo sapiens
attctttattctgcctttgtcctggtgagcacatctgatatggcagaggaaactgaggatgcctggccgcacctcagcgagagcagcagcagcgatagcagccgcagaagagccagcggggtcgcctagtgtcatgaccagggcgggagatcacaaccgccagagaggatgctgtggatccttggccgactacctgacctctgcaaaat

SEQ ID NO: 670 - DNA, 592 bp, Homo sapiens
acagggcacatactcatgcgtggctcccttcactactgggtgtcagtctggcctgtgctcaaggtgtggcatctggttggagtttcaatatgtaggatccactaccagggttttcgtgagattaagaagggtaaggtaacctactggcaaaaggggctggtatgccccaggggttggtttggcacagcaggattaaaacgaagtcaaccaaggctagagtctggtgttctttagtcattcacctcaccctccaggaggccaccgaatggctttatctggacagggacagatccagggacacaactgggataaccggtattcctgaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaa

SEQ ID NO: 671 - DNA, 2368 bp, Homo sapiens
atgagagccagcattcataagaaacttcgcaagagcagtggaatagtgaccattctttattctgcctttgtcctggtgagcacatctgatatggcagaggaaactgaggatgcctggccgaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgttctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttattttt

SEQ ID NO: 672 - DNA, 2286 bp, Homo sapiens
cttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatctt

SEQ ID NO: 673 - DNA, 7028 bp, Homo sapiens
ggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatctttagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggatacaacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttttgtttttgttttttaagggaaacgaaatggaattcgaagggaccttttcactaaccccacttctgtgtgttctgcatggcgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgacctac

SEQ ID NO: 674 - DNA, 2656 bp, Homo sapiens
aaacttatgatgaataaagccaggaactcttgcttattttctgtcctccctctgctcctgtcactaactacttctgtaaacataacttcccaacttctactccaactttaaagcatctggttccttaaataaacaggccctgtagagaggccgtgttgtatggggtgtcagctctgggaagaatgcgtgtgtttgtttgctggctctggcagggttgagtccaagctgacaggactgagtgtgcctgtcagaggcttcagggagctgccgctgaagacctcggcctgttgttgtgaatcgccagacctttgtaacacccggaagtctgaagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatctttagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcactgaccttggggctctggaattatggagaacttcagacttgggaaaaagcttcaaaactattggtgtgaaaatctactcatttggtcttgggggacgtttcctttttgcctctgtgatggctgataaggatacaacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaa

SEQ ID NO: 675 - DNA, 2007 bp, Homo sapiens
acaggttaaatactgcagagctaatagattggagtgacttctgacctagtcacatcttaaaggaaaacttttcagtttttactttaaaaggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttg

SEQ ID NO: 676 - DNA, 2349 bp, Homo sapiens
aggtggttagcagcacctcataaggtccttcctagcaagggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcatttggaggctggaagtctgggatcaaggtattagcagaattggtttcttctgagagtcatgagggaaaaatgtgtttcaggcctcttcccttggcttacaggaaatgaaaaaaccatgactatcatcaccaacatccttgggtattaagtgcagtcactctcctagatgctgtggggagaaggcaagttacaaagatagaccttccctcaagataatcagattttcatggtattatccttaacctttttgacatcatggaggctttgggaatctgatgaagcctatcaattttcttccagaagatatttatataagattataagaaaaattatgtacacagcttattttattgcattggatcaaaatgccatttataaagaattatgccttttccatcaattttagcatggaaaaataatttcaggcaatatgcttaaaaattgggggaagacaaaagaaatccatatcgtgtaaataaaaataaattttggttttgctcaaaaataaa

SEQ ID NO: 677 - DNA, 1969 bp, Homo sapiens
tggtcttccagttgtcctgagagtgatgactggctccaccttgatgtggctcacataaattcagaaagtatgatagcagtgtaggtggttagcagcacctcataaggtccttcctagcaagggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaa

SEQ ID NO: 678 - DNA, 760 bp, Homo sapiens
ttccagttgtcctgagagtgatgactggctccaccttgatgtggctcacataaattcagaaagtatgatagcagtgtaggtggttagcagcacctcataaggtccttcctagcaaggttaaatactgcagagctaatagattggagtgacttctgacctagtcacatcttaaaggaaaacttttcagtttttactttaaaaggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaa

SEQ ID NO: 679 - DNA, 2220 bp, Homo sapiens
atgggagaatggggaacgtggaggtaaaggagggaacctaatgtaagaatactgaatttgccaattaaggcaccagctgtgactacttcatacaggaatggggacatgcctgatgccatagggtctaattgacttgagaatgtgaaaggaaaataaaaactcagaaccccaattcatcatgccaaaaggaaaaaaaaattaagctgaaatgttaaatactgcagagctaatagattggagtgacttctgacctagtcacatcttaaaggaaaacttttcagtttttactttaaaaggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttgaaaagaa

SEQ ID NO: 680 - DNA, 2154 bp, Homo sapiens
gatagcagtgtaggtggttagcagcacctcataaggtccttcctagcaaggtaacagtacaagctttttctaaaaatcttgatgtatacctgatctcctggttgaaagagttggcttgatggattttttcctataagttctttttatgtctagatttttatgttccacttgacctgatgattgaggatggtatgaagtaagaagttttaatgagtaatccagagattttggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttgaaaagaa

SEQ ID NO: 681 - DNA, 2326 bp, Homo sapiens
atcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaaggtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactcc

SEQ ID NO: 682 - DNA, 2452 bp, Homo sapiens
ggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactcc

SEQ ID NO: 683 - DNA, 2290 bp, Homo sapiens
atcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaaaggtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactcc

SEQ ID NO: 684 - DNA, 2188 bp, Homo sapiens
gtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggat

SEQ ID NO: 685 - DNA, 2211 bp, Homo sapiens
ggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 686 - DNA, 2446 bp, Homo sapiens
cagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttgga

SEQ ID NO: 687 - DNA, 2500 bp, Homo sapiens
ctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactg

SEQ ID NO: 688 - DNA, 1318 bp, Homo sapiens
atggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtga

SEQ ID NO: 689 - DNA, 3664 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattg

SEQ ID NO: 690 - DNA, 1867 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaa

SEQ ID NO: 691 - DNA, 1302 bp, Homo sapiens
acccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaag

SEQ ID NO: 692 - DNA, 3540 bp, Homo sapiens
ggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagacaa

SEQ ID NO: 693 - DNA, 4109 bp, Homo sapiens
ccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgctctcgggttgtgtgtctgttcacttttcctccctcagtgccctcattttatgtcattaaatggggctcacaaaccatgcaaatgctatgagatgcatggagggctgccctgtaccccagcacttgtgttgtctggtggtggcaccatctctgattttcaaagctttttccagaggctattattttcactgtagaatgatttcatgctatctctgtgtgcacaaatatttattttctttctgtaaccataacaacttcatatatgaggacttgtgtctctgtgcttttaaatgcataaatgcattataggatcatttgttggaatgaattaaataaacccttcctggggcatctggcgaatccca

SEQ ID NO: 694 - DNA, 3480 bp, Homo sapiens
tataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtg

SEQ ID NO: 695 - DNA, 1855 bp, Homo sapiens
tcttcctacccatctgctccccagagggctgcctgctgtgcacttgggtcctggagcccttctccacccggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgaataagctttctctcagaaatgctgtccctatacactagacaaaactgagcctgtataaggaataaatgggagcgccgaaaagctccctaaaaagcaa

SEQ ID NO: 696 - DNA, 1160 bp, Homo sapiens
tcttcctacccatctgctccccagagggctgcctgctgtgcacttgggtcctggagcccttctccacccggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaagacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaa

SEQ ID NO: 697 - DNA, 1132 bp, Homo sapiens
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctat

SEQ ID NO: 698 - DNA, 1505 bp, Homo sapiens
cctacccatctgctccccagagggctgcctgctgtgcacttgggtcctggagcccttctccacccggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgc

SEQ ID NO: 699 - DNA, 2888 bp, Homo sapiens
cgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataagcca

SEQ ID NO: 700 - DNA, 2631 bp, Homo sapiens
cgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataagcca

SEQ ID NO: 701 - DNA, 3131 bp, Homo sapiens
cacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 702 - DNA, 2191 bp, Homo sapiens
actacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggctggagtgcagtggtgcaatcttggctcactgcaacctccacctcccgggttcaagtgattcttctgcctcagactccagagtatctaggattacaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatc

SEQ ID NO: 703 - DNA, 2199 bp, Homo sapiens
ccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcgg

SEQ ID NO: 704 - DNA, 5053 bp, Homo sapiens
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaataagtctgtaagtttttttttttctttttaattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtcttttcttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgttttttttttttttaatttgggggttctgtaaggtctttatttcccataagtaaatattgccatgggaggggggtggaggtggcaaggaaggggtgaagtgctagtatgcaagtgggcagcaattatttttgtgttaatcagcagtacaatttgatcgttggcatggttaaaaaatggaatataagattagctgttttgtattttgatgaccaattacgctgtattttaacacgatgtatgtctgtttttgtggtgctctagtggtaaataaattatttcgatgatatgtggatgtctttttcctatcagtaccatcatcgagtctagaaaacacctgtgatgcaataagactatctcaagctggaaaagtcataccacctttccgattgccctctgtgctttctcccttaaggacagtcacttcagaagtcatgctttaaagcacaagagtcaggccatatccatcaaggatagaagaaatccctgtgccgtctttttattcccttatttattgctatttggtaattgtttgagatttagtttccatccagcttgactgccgaccagaaaaaatgcagagagatgtttgcaccatgctttggctttctggttctatgttctgccaacgccagggccaaaagaactggtctagacagtatcccctgtagccccataacttggatagttgctgagccagccagatataacaagagccacgtgctttctggggttggttgtttgggatcagctacttgcctgtcagtttcactggtaccactgcaccacaaacaaaaaaacccaccctatttcctccaatttttttggctgctacctacaagaccagactcctcaaacgagttgccaatctcttaataaataggattaataaaaaaagtaattgtgactcaa

SEQ ID NO: 705 - DNA, 4969 bp, Homo sapiens
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaataagtctgtaagtttttttttttctttttaattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtcttttcttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgttttttttttttttaatttgggggttctgtaaggtctttatttcccataagtaaatattgccatgggaggggggtggaggtggcaaggaaggggtgaagtgctagtatgcaagtgggcagcaattatttttgtgttaatcagcagtacaatttgatcgttggcatggttaaaaaatggaatataagattagctgttttgtattttgatgaccaattacgctgtattttaacacgatgtatgtctgtttttgtggtgctctagtggtaaataaattatttcgatgatatgtggatgtctttttcctatcagtaccatcatcgagtctagaaaacacctgtgatgcaataagactatctcaagctggaaaagtcataccacctttccgattgccctctgtgctttctcccttaaggacagtcacttcagaagtcatgctttaaagcacaagagtcaggccatatccatcaaggatagaagaaatccctgtgccgtctttttattcccttatttattgctatttggtaattgtttgagatttagtttccatccagcttgactgccgaccagaaaaaatgcagagagatgtttgcaccatgctttggctttctggttctatgttctgccaacgccagggccaaaagaactggtctagacagtatcccctgtagccccataacttggatagttgctgagccagccagatataacaagagccacgtgctttctggggttggttgtttgggatcagctacttgcctgtcagtttcactggtaccactgcaccacaaacaaaaaaacccaccctatttcctccaatttttttggctgctacctacaagaccagactcctcaaacgagttgccaatctcttaataaataggattaataaaaaaagtaattgtgactcaa

SEQ ID NO: 706 - DNA, 2522 bp, Homo sapiens
tgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatat

SEQ ID NO: 707 - DNA, 1280 bp, Homo sapiens
ggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccggtgagactgggcccacatgggaaccaacatctactgcctgcctactgcccaatggctaggtcaggccccagagccaagccacactcaacagagggtccctgatgctattcacaaacatctccaggaagaagactgaaaatctctcacagagattttctctgtgaaatctctttctgttttcctgggagtcccactgtttttccataggctaactctggaaggagctggctgaagtaaatgaggaaaactctgtg

SEQ ID NO: 708 - DNA, 957 bp, Homo sapiens
agacaaggttcatatttgtatgggttacttattctctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttccattgtcttgcaagcaaagcacgtattaaatatgatctgcagccattaaaaaga

SEQ ID NO: 709 - DNA, 1037 bp, Homo sapiens
gttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtgagtatacagaccttcgaggcattccaggaaatattatacaagaaaaaattcacaacactttggcactggacttccggtggtcagtcattttttcgggctctggtggaagtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttccattgtcttgcaagcaaagcacgtattaaatatgatctgcagccattaaaaagacacattctgt

SEQ ID NO: 710 - DNA, 556 bp, Homo sapiens
gttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctactactcctattccaccacggctgtcgtcaccaatcccaaggaatga

SEQ ID NO: 711 - DNA, 2933 bp, Homo sapiens
gcccagttggagccagacagcggggtggacaagtggcgtgtgtgctgcgaccccgagggaagatgaacgggacgcggaactggtgtaccctggtggacgtgcacccagaggaccaggcggcggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgtgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgcgcccggcccatggtgtttttctttagggctcttcctacaaccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttg

SEQ ID NO: 712 - DNA, 3033 bp, Homo sapiens
cagttggagccagacagcggggtggacaagtggcgtgtgtgctgcgaccccgagggaagatgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgtgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgcgcccggcccatggtgtttttctttagggctcttcctacaaccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 713 - DNA, 3111 bp, Homo sapiens
gcccagttggagccagacagcggggtggacaagtggcgtgtgtgctgcgaccccgagggaagatgaacgggacgcggaactggtgtaccctggtggacgtgcacccagaggaccaggcggcgggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgtgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgcgcccggcccatggtgtttttctttagggctcttcctacaaccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 714 - DNA, 2107 bp, Homo sapiens
agcggggtggacaagtggcgtgtgtgctgcgaccccgagggaagatgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgcgcccggcccatggtgtttttctttagggctcttcctacaaccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtc

SEQ ID NO: 715 - DNA, 1767 bp, Homo sapiens
agttggagccagacagcggggtggacaagtggcgtgtgtgctgcgaccccgagggaagatgaacgggacgcggaactggtgtaccctggtggacgtgcacccagaggaccaggcggcggagcagaaattctggattgaggatgagcagtccaggaatgacctctctacaactagagaaagaagaatgcatgcaatgtgttccctgtagtccaagaaccagggtagccctgctggagctctacagagccatgtgccagggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgtgccataagccaggccttcatcagattgggagaggtgacaagatttgcctcagccctaaaagctggagacacagatgt

SEQ ID NO: 716 - DNA, 992 bp, Homo sapiens
cagttggagccagacagcggggtggacaagtggcgtgtgtgctgcgaccccgagggaagatgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaacc

SEQ ID NO: 717 - DNA, 2579 bp, Homo sapiens
gttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 718 - DNA, 1152 bp, Homo sapiens
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagaaaacatttccggccaggcacggtggatcacacctgtaatcccagctactcgggaggctgaggcaggagaatcgcttgaacccaggaggcagagggttgcagtgagccgagattgcgccattgcactctagcctgggcaacagagcaagactccatctc

SEQ ID NO: 719 - DNA, 2466 bp, Homo sapiens
gagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcc

SEQ ID NO: 720 - DNA, 1018 bp, Homo sapiens
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccaggccaaggcaggtggatcacctgaggtcaggagttcaagacagcctggccaacatagcgaaatcccatctctactaaaaatacaaaaattagcctggcagtggtggcccacgcctgtaatcccagctactaagggggctgaggcaggaggatctcttaaccagggaggaggaggttgcagtgagcagagattgtgccactgcactccagcctgtgcaacagagtgagactctgtctc

SEQ ID NO: 721 - DNA, 808 bp, Homo sapiens
aaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtctctgggaggaggggttaa

SEQ ID NO: 722 - DNA, 1075 bp, Homo sapiens
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagccacctgaagtccaaaaagggtcagtctacctcccgccataaaaaactcatgttcaagacagaagggcctgactcagactga

SEQ ID NO: 723 - DNA, 2653 bp, Homo sapiens
ctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgagggg

SEQ ID NO: 724 - DNA, 2506 bp, Homo sapiens
aaaagtctagagccaccgtccagggagcaggtagctgctgggctccggggacactttgcgttcgggctgggagcgtgctttccacgacggtgacacgcttccctggattggccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 725 - DNA, 2580 bp, Homo sapiens
ctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgagggg

SEQ ID NO: 726 - DNA, 565 bp, Homo sapiens
ttcgggctgggagcgtgctttccacgacggtgacacgcttccctggattggggctgaggagtgtccgaagagaatgggcaggtgagcggtgagacagttgttcttccagaagctttgcagtgaaaggaatcaaagaaatggagccgtgtatcagcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccc

SEQ ID NO: 727 - DNA, 634 bp, Homo sapiens
aatgcagggctgaggagtgtccgaagagaatgggcaggtgagcggtgagacagttgttcttccagaagctttgcagtgaaaggaatcaaagaaatggagccgtgtatcagcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagt

SEQ ID NO: 728 - DNA, 729 bp, Homo sapiens
aaaagtctagagccaccgtccagggagcaggtagctgctgggctccggggacactttgcgttcgggctgggagcgtgctttccacgacggtgacacgcttccctggattggtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcag

SEQ ID NO: 729 - DNA, 546 bp, Homo sapiens
ttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggag

SEQ ID NO: 730 - DNA, 2220 bp, Homo sapiens
gagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcc

SEQ ID NO: 731 - DNA, 2466 bp, Homo sapiens
tattgagttcttcaaacattgtagcctctttatggtctctgagaaataactaccttaaacccataatctttaatacttcctaaactttcttaataagagaagctctattcctgacactacctctcatttgcaaggtcaaatcatcattagttttgtagtctattaactgggtttgcttaggtcaggcattattattactaaccttattgttaatattctaaccataagaattaaactattaatggtgaatagagtttttcactttaacataggcctatcccactggtgggatacgagccaattcgaaagaaaagtcagtcatgtgcttttcagaggatgaaagcttaagataaagactaaaagtgtttgatgctggaggtgggagtggtattatataggtctcagccaagacatgtgataatcactgtagtagtagctggaaagagaaatctgtgactccaattagccagttcctgcagaccttgtgaggactagaggaagaatgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggatttgctagtccacttactgggatagcggatgcctctcaaagcagcatgcacaatgccttgcacatctatatgaatggaacaatgtcccaggtacagggatctgccaacgatcctatcttccttcttcaccatgcatttgttgacagtatttttgagcagtggctccgaaggcaccgtcctcttcaagaagtttatccagaagccaatgcacccattggacataaccgggaatcctacatggttccttttataccactgtacagaaatggtgatttctttatttcatccaaagatctgggctatgactatagctatctacaagattcagacccagactcttttcaagactacattaagtcctatttggaacaagcgagtcggatctggtcatggctccttggggcggcgatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataaaaggcttaggcaatagagtagggccaaaaagcctgacctcactctaactcaaagtaatgtccaggttcccagagaatatctgctggtatttttctgtaaagaccatttgcaaaattgtaacctaatacaaagtgtagccttcttccaactcaggtagaacacacctgtctttgtcttgctgttttcactcagcccttttaacattttcccctaagcccatatgtctaaggaaaggatgctatttggtaatgaggaactgttatttgtatgtgaattaaagtgctcttattttaaaaaattgaaataattttgatttttgccttctgattatttaaagatctatatatgttttattggccccttctttattttaa

SEQ ID NO: 732 - DNA, 3983 bp, Homo sapiens
ggagactatttcaggagttaggatttgcatctgagttcattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcaaaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgaaaagcatcctatgtcgcaccccgggagagttttaccacaacactctgagcttcctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgtttcattacctatgaggtttcatttacttctttgtaaatgtactgacttttggagttacttaagaaccacagttcctaaaacattttatttgggagctcaacttctggcttcctacttaccaagaggcagtaagttataacctctggcctttgtctttacattttcaactttctggatccctaacctctggtcccaagttactacgcttgcctatatccactaaccactcactaggtcacaaagttgatggctctggcttgacccagtgaatgagaagtgtcctagatgtttttttttttttttttttttcgcaaatcttcataggcacagttgcctgtttaattttttcttcagcccttcccttagaggagggagccttaagttacctttcaaggttgggggttaggaatctatcataactagtctagagatttctcaccaagggaaattttccttatctaaaagaggaacttcaggtctcaaccctgccagtcacacccaattaatgtccttcacaaaaataaacagcatatgttccctttcaatttgagttcagtgagctcacagcaaaatttaccttttaattttcttcagcaaatccaagacgaatatacaaaggatgagattagataaagatttcagtttcccgtatgccaccgctgccgccaattttccaaaaaagcctggctcctcttttcctgttcctccatccaagcccccaaagatctctaaccagaaataaacaggaagactcagtgatttacaaaagacattttagttttacacgtacagaaaattctacccagcattacagaattcttagacttcttaaattcctgattttccttggtatttacattttgataagggagccaatggttcttcaaacatttgaaaagaacacatacacactggacaatttcaaacgatacaaacaaacgcaactgtccttctttctcattcctgtccttcagccacccagtttcttctcccctgagggaatcagttatcatttgctggtcatacttccagattatactgtgcctatgtaagtgtgtgtgtgtgtgtgtgtgtgtgcacttttcattttttcaaataaagtattactcaactttgtaa

SEQ ID NO: 733 - DNA, 2382 bp, Homo sapiens
aagtaggagagggcgaacctctggcaggagcaaaggcgccatggctgtggagtcccagggcggacgcccacttgtcctgggcctgctgctgtgtgtgctgggcccagtggtgtcccatgctgggaagatactgttgatcccagtggatggcagccactggctgagcatgcttggggccatccagcagctgcagcagaggggacatgaaatagttgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 734 - DNA, 3389 bp, Homo sapiens
atggctgtggagtcccagggcggacgcccacttgtcctgggcctgctgctgtgtgtgctgggcccagtggtgtcccatgctgggaagatactgttgatcccagtggatggcagccactggctgagcatgcttggggccatccagcagctgcagcagaggggacatgaaatagttgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagaaagaagcagcagtcaggaagacagatgtgaagagctggagcatgttcagatgagaggagacggaacacggggacacaccagcttgagcaagggacaacaggggaggactgatgactgacttcccacctttgaggtgctaatgtgtgtgtggtggcactggataaaagatcaatgttggctaggcaccatggcacacgcctgtagtcccagccactctggaggctaaggcgggaggattgcttgagcccagaagttggaggctgctatgagccgtgatcatgccactgcactccagcaacctgggcaacagagtgagaccctgtctcaaaaaaaaaaaaaaaaatgaaaagtccacataacctgagcatcatgtgcccagagcgttgggtggtgtggtcccattccttccttccagcggcttcttctggccacctcaatgtcaggatgtcctgctcacatatcaataccattaaaacctgacttctttccctgcactgttgaagctccttcttgaggctcacattatggatataattttgattctttcttcagtggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgattccaacactctgagctggggatagtgcctacacaaaataaaaagaagtggaaaattttcaaacatcagtttatgctgacaaccaggccataataggtgctcaattactattgaatgaatgaatgaaagttctggccaggtacggtggctcatgcctgtagtcccaacactttgggaggccgaggcaggtggatcacttgaggttaggagttcgaaaccaacctgaccaacatgaagaaaccttatctctaccaaaaaaatataaaaaaattacccaggcatggtggtgtatgcctgtaatcccagctatttgggaggctgaggcaggaaaatcacttgaacctgagaggcggaggttgcagtgagctgagattgtgccactccactccagcctgggcgacagagtgagactccgtcttacttaaaaaaaaaaaaaagaaggttccaagaaaattcatcttaaggtttatgtaaaaggaagatgatatttaacatgattcatggccaagtactaatattacattataataatgtttccaaataacattatagatatgtttaaagacagtgtattaggctgttcttgcattgctgtaaagaaatacccaagactgggtaatttataaagaaaagaggtttcattggctcgtgtttctgcaggctgtacaggaagcttagtgctgacatcacttggctgccgggggaacctcagggagcttttactcatggcagaaggcaatgcgggagcttgcatgtcacatggcaaaagcaggagcgagagagagttgggggggaaggtgccacacactttttaatgaccggctctcacaataactcatgaaaactcactatcaggaagacagcactaaagcacaagggatccgaccccatgatccaaacacctcccaccaggccccatctccagcactggggattacaattcaacatgagatctgagtgtggacaaatatccaaactgtatcagtcaacagcgatcataattagtcctgaataggagtgcctttttttttctttcttctcccttttcttttctacttcctcctccttttccctctcctcttcaatctcctcttcattcctgtagcaccaagggttgaagcacctaacccgttttggattgagatgttctgattgggcaatgaacactgtccagaataaacagaaatccattttgcactaagtggctgcacagaccctgcctcatgctaaatctagcacccagatagtttaatgtttcaatgactgaattacaaatatatcatcaccttggatttggcacttacaaatggctgttaatttggccagaggtggttgtttacaacttcaaataggagactattcataatttctgacgtg

SEQ ID NO: 735 - DNA, 2408 bp, Homo sapiens
gtacttcttccgcctactgtatcatagcagcttagaatcccagctgctggctcgggctgcagttctctcatggctcgcgcagggtggaccagccccgttcctttatgtgtgtgtctactgctgacctgtggctttgccgaggcagggaagctgctggtagtgcccatggatgggagtcactggttcaccatgcagtcggtggtggagaaacttatcctcagggggcatgaggtggttgtagtcatgccagaggtgagttggcaactggaaagatcactgaattgcacagtgaagacttactcaacctcgtacactctggaagatcagaaccgggaattcatggttttcgcccatgctcaatggaaagcacaggcacaaagtatattttctctattaatgagttcatccagtggttttcttgacttatttttttcgcattgcaggagtttgtttaatgaccgaaaattagtagaatacttaaaggagagttcttttgatgcagtgtttctggatccttttgatacctgtggcttaattgttgctaaatatttctccctcccctctgtggtcttcaccaggggaatattttgccaccatcttgaagaaggtgcacagtgccctgctcctctttcctatgtccccaatgatctcttagggttctcagatgccatgactttcaaggagagagtatggaaccacatcgtgcacttggaggaccatttattttgccagtatctttttagaaatgccctagaaatagcctctgaaattctccaaacccctgtcacggcatatgatctctacagtcacacatcaatttggttgttgcgaacggactttgttttggactatcccaaacccgtgatgcccaacatgatcttcattggtggtatcaactgtcatcagggaaagccattgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaa

SEQ ID NO: 736 - DNA, 2364 bp, Homo sapiens
gtccgtgtcttctgctgagatggccacaggactccaggttcccctgccgtggctggccacaggactgctgcttctcctcagtgtccagccctgggctgagagtggaaaggtgttggtggtgcccattgatggcagccactggctcagcatgcgggaggtcttgcgggagctccatgccagaggccaccaggcagtggtcctcaccccagaggtgaatatgcacatcaaagaagagaactttttcaccctgacaacctatgccatttcgtggacccaggatgaatttgatcgccatgtgctgggccacactcaactgtactttgaaacagaacattttctgaagaaatttttcagaagtatggcaatgttgaacaatatgtctttggtctatcataggtcttgtgtggagctactacataatgaggccctgatcaggcacctgaatgctacttcctttgatgtggttttaacagaccccgttaacctctgcgcggcagtgctggctaagtacctgtcgattcctactgtgttttttttgaggaacattccatgtgatttagactttaagggcacacagtgtccaaacccttcctcctatattcctagattactaacaaccaattcagaccacatgacattcatgcaaagggtcaagaacatgctctaccctctggccctgtcctacatttgccatgctttttctgctccttatgcaagccttgcctctgagctttttcagagagaggtgtcagtggtggatattctcagtcatgcatctgtgtggctgttccgaggggactttgtgatggactaccccaggccaatcatgcccaacatggtcttcattgggggcatcaactgtgccaacaggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 737 - DNA, 1924 bp, Homo sapiens
agtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttaaatagaaaggatatcatggattccttaaagaatgagaacttcgacatggtgatagttgaaacttttgactactgtcctttcctgattgctgagaagcttgggaagccatttgtggccattctttccacttcattcggctctttggaatttgggctaccaatccccttgtcttatgttccagtattccgttccttgctgactgatcacatggacttctggggccgagtgaagaattttctgatgttctttagtttctgcaggaggcaacagcacatgcagtctacatttgacaacaccatcaaggaacatttcacagaaggctctaggccagttttgtctcatcttctactgaaagcagagttgtggttcattaactctgactttgcctttgattttgctcgacctctgcttcccaacactgtttatgttggaggcttgatggaaaaacctattaaaccagtaccacaagacttggagaacttcattgccaagtttggggactctggttttgtccttgtgaccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaattctttccagtcctcttgtcctcctttgtttgccatcagcaagggctatgctgtgattctgtctctgagtgacttggaccactgaccctcagatttccagccttaaaatccaccttccttctcatgcgcctctccgaatcacaccctgactctt

SEQ ID NO: 738 - DNA, 2355 bp, Homo sapiens
cccacagccagtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtaggtggaagccattatctactgatggaccgggtttctcagattcttcaagatcacggtcataatgtcaccatgcttaaccacaaaagaggtccttttatgccagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttaaatagaaaggatatcatggattccttaaagaatgagaacttcgacatggtgatagttgaaacttttgactactgtcctttcctgattgctgagaagcttgggaagccatttgtggccattctttccacttcattcggctctttggaatttgggctaccaatccccttgtcttatgttccagtattccgttccttgctgactgatcacatggacttctggggccgagtgaagaattttctgatgttctttagtttctgcaggaggcaacagcacatgcagtctacatttgacaacaccatcaaggaacatttcacagaaggctctaggccagttttgtctcatcttctactgaaagcagagttgtggttcattaactctgactttgcctttgattttgctcgacctctgcttcccaacactgtttatgttggaggcttgatggaaaaacctattaaaccagtaccacaagacttggagaacttcattgccaagtttggggactctggttttgtccttgtgaccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaattctttccagtcctcttgtcctcctttgtttgccatcagcaagggctatgctgtgattctgtctctgagtgacttggaccactgaccctcagatttccagccttaaaatccaccttccttctcatgcgcctctccgaatcacaccctgactcttccagcctccatgtccagacctagtcagcctctctcactcctgcccctactatctatcatggaataacatccaagaaagacaccttgcatattctttcagtttctgttttgttctcccacatattctcttcaatgctcaggaagcctgccctgtgcttgagagttcagggccggacacaggctcacaggtctccacattgggtccctgtctctggtgcccacagtgagctccttcttggctgagcaggcttggagactgtaggtttccagatttcctgaaaaataaaagtttacagcgttatctctccccaacctcactaa

SEQ ID NO: 739 - DNA, 572 bp, Homo sapiens
acatcagctcaagattttaagcaagtctctcaggaaatagatcgcggggctggcagtatgagccagtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtaggtggaagccattatctactgatggaccgggtttctcagattcttcaagatcacggtcataatgtcaccatgcttaaccacaaaagaggtccttttatgccagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttaaatagaaaggatatcatggattccttaaagaatgagaact

SEQ ID NO: 740 - DNA, 1476 bp, Homo sapiens
agtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtaggtggaagccattatctactgatggaccgggtttctcagattcttcaagatcacggtcataatgtcaccatgcttaaccacaaaagaggtccttttatgccagattttaaaaaggaagaaaaatcatatcaagttatcagttggcttgcacctgaagatcatcaaagagaatttaaaaagagttttgatttctttctggaagaaactttaggtggcaggacttggagaacttcattgccaagtttggggactctggttttgtccttgtgaccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaattctttccagtcctcttgtcctcctttgtttgccatcagcaagggctatgctgtgattctgtctctgagtgacttggaccactgaccctcagatttccagccttaaaatccaccttccttctcatgcgcctctccg

SEQ ID NO: 741 - DNA, 993 bp, Homo sapiens
gcctggccggccgcgtgttcccggagcctcggctgcccgaatggggagcccagagtggcgagcggcacccctccccccgccagccctccgcgggaaggtgacctctcgagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatat

SEQ ID NO: 742 - DNA, 954 bp, Homo sapiens
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagatgtgacaagccgaggcggtga

SEQ ID NO: 743 - DNA, 1286 bp, Homo sapiens
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatc

SEQ ID NO: 744 - DNA, 2909 bp, Homo sapiens
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 745 - DNA, 3535 bp, Homo sapiens
ggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 746 - DNA, 2834 bp, Homo sapiens
gcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 747 - DNA, 1197 bp, Homo sapiens
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctc

SEQ ID NO: 748 - DNA, 1081 bp, Homo sapiens
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaagatgtgacaagccgaggcggtga

SEQ ID NO: 749 - DNA, 1575 bp, Homo sapiens
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaa

SEQ ID NO: 750 - DNA, 414 bp, Homo sapiens
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagatgtgacaagccgaggcggtga

SEQ ID NO: 751 - DNA, 1146 bp, Homo sapiens
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatctctcaccaggaaagactgatacagaacgatcgatacagaaaccacgctg

SEQ ID NO: 752 - DNA, 630 bp, Homo sapiens
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtga

SEQ ID NO: 753 - DNA, 606 bp, Homo sapiens
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatctctcaccaggaaagactgatacagaacgatcgatacagaaaccacgctg

SEQ ID NO: 754 - DNA, 970 bp, Homo sapiens
ccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtatgtgacaagccgaggcggtga

SEQ ID NO: 755 - DNA, 1199 bp, Homo sapiens
gcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaa

SEQ ID NO: 756 - DNA, 541 bp, Homo sapiens
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaagatgtgacaagccgaggcggtga

SEQ ID NO: 757 - DNA, 784 bp, Homo sapiens
gcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatc

SEQ ID NO: 758 - DNA, 954 bp, Homo sapiens
gcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacc

SEQ ID NO: 759 - DNA, 2067 bp, Homo sapiens
gaggagggggacgagggctctggcgggtttggaggggctgaacatcgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggcttatgcaagcaaagatctggaggagcagttacggtctgtgtccagtgtagatgaactcatgactgtactctacccagaatattggaaaatgtacaagtgtcagctaaggaaaggaggctggcaacataacagagaacaggccaacctcaactcaaggacagaagagactataaaatttgctgcagcacattataatacagagatcttgaaaagtattgataatgagtggagaaagactcaatgcatgccacgggaggtgtgtatagatgtggggaaggagtttggagtcgcgacaaacaccttctttaaacctccatgtgtgtccgtctacagatgtgggggttgctgcaatagtgaggggctgcagtgcatgaacaccagcacgagctacctcagcaagacgttatttgaaattacagtgcctctctctcaaggccccaaaccagtaacaatcagttttgccaatcacacttcctgccgatgcatgtctaaactggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcctcttgtgatttctttaaaagaatgactatataatttatttccactaaaaatattgtttctgcattcatttttatagcaacaacaattggtaaaactcactgtgatcaatatttttatatcatgcaaaatatgtttaaaataaaatgaaaattgtattataa

SEQ ID NO: 760 - DNA, 1581 bp, Homo sapiens
gggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgagaggcacagaaatggacaccagaaataaggcccagctccttgtgctcctgactcttctcagtgtgctcttctcacagacttcggcatggcctctttacagggcaccttctgctctcaggttgggtgacagaataccctttgagggagcaaatgaacctgatcaagtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagtaacatctcagaagaccctgtaccagtcaaacgtcactcagatgcagtcttcactgacaactatacccgccttagaaaacaaatggctgtaaagaaatatttgaactcaattctgaatggaaagaggagcagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataa

SEQ ID NO: 761 - DNA, 1584 bp, Homo sapiens
gggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgagaggcacagaaatggacaccagaaataaggcccagctccttgtgctcctgactcttctcagtgtgctcttctcacagacttcggcatggcctctttacagggcaccttctgctctcaggttgggtgacagaataccctttgagggagcaaatgaacctgatcaagtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagcagtaacatctcagaagaccctgtaccagtcaaacgtcactcagatgcagtcttcactgacaactatacccgccttagaaaacaaatggctgtaaagaaatatttgaactcaattctgaatggaaagaggagcagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataa

SEQ ID NO: 762 - DNA, 1257 bp, Homo sapiens
agtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagcagtaacatctcagaagaccctgtaccagtcaaacgtcactcagatgcagtcttcactgacaactatacccgccttagaaaacaaatggctgtaaagaaatatttgaactcaattctgaatggaaagaggagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataa

SEQ ID NO: 763 - DNA, 2042 bp, Homo sapiens
ggagtttattcataacgcgctctccaagtatacgtggcaatgcgttgctgggttattttaatcattctaggcatcgttttcctccttatgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctggaggaacaagaagatgaggaagaaatcgatgttgtttctgtggaaaagaggcaggctcctggcaaaaggtcagagtctgg

SEQ ID NO: 764 - DNA, 2345 bp, Homo sapiens
ctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaa

SEQ ID NO: 765 - DNA, 1893 bp, Homo sapiens
aactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaaga

SEQ ID NO: 766 - DNA, 2150 bp, Homo sapiens
gggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgattt

SEQ ID NO: 767 - DNA, 8838 bp, Homo sapiens
gtggcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcaggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcaccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgactgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgcgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaactgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggc

SEQ ID NO: 768 - DNA, 2303 bp, Homo sapiens
aaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccaggtgggtttcatcgggtgggcccagcgggacagggccgggtgaaattagggagggggctgggctggggcgcaatggaggccgagccaatcccggactcctcaatgccagcaaagcttctggcgccgccctgtctgaacctggagcggctgggaggatccccctcccaggagaagccgaggaccccaggatgctgcagaatcagtgagaggtgcgtaaggccaaaccccattccccggaccccgctagcacttcaccacctggctcagtgatcaaggggtcatgacctctctttgctggggttatcgagaagtggcaattttataatagttactgaaacttacaaagaggttctggtgcccagagacacttggggtcatctagggatcagaggccatgcaattccatgtctctggggctgatgtaggcactccccagggatcatccaggggttatggagggcaactcaataataatgaaaatgataaaaatcgtaatcatattatggcaagccagcggcgtggtggcgcgtgcctgtaagtcccagctactcgggaggctgaggcggaaggatcggtcgagcccaggagttctaggctgcactgagtcctgatcacgcccctgcactccaggcgggggtacagagtgaggctcggtctctaaaagaaacacaaagaaaaaaagtaacctttttctcgatcctgcagccagaggcttgatatcctgcctcggtcacctagggcggtccctgcctgggtgatctacgggtgccgtaaggggttgattgatgtggagggctgggcgtgcctgggaggcccacagtgggcgaggtgagttgcaattactgcaactcttaaaccttccacccagagttagaaatgactgaacctcaggtggggtgtgtagcctgtccaagggtacacaaagagccggcccaagttggaaccccctggccggctaaacccaggagtcacccaagaaaacgtgaccccactgcccttctccccaggtccctctggcctgcatgccaggagtcggtcaccgccctgtgcttcctccaagagacagtggagaggctgggtcagtcccctgcccaggacaccccggtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacagcctgccctgcagtagccgttctcaggaatcccctgcagatgctgttgggggccctgcagcccacccaggaggcaccgaggcccactcagcaggcagcgaggccctggagccccggcgctgtgcttcctgtcggacccagaggaccccgctctggagagacgctgaagatgggacccctctctgcaacgcctgtgggatcaggtacaagaaatacggcactcgctgctccagctgctggctggtgcccaggaaaaatgtccagcccaagaggctatgtggcagatgtggagtgtccctggaccccattcaggaaggttaaacccagcttcaccctgctgagctgctgcttctgcctccgtttcaccagtgggagaatgggcagaagcagctctcctaggaggattggggaaagagccggcctgcctcctctctgccatctccagattcaaggatcccgggggaagacccaggcctcaggtggcagagcctgctaggggtcaccagccccttctccagtcagccttggccgaggccccctcaggagacgctctcaggaaggatgagcattgttacagcagggacaataaagtacagagatatgccgaga

SEQ ID NO: 769 - protein, 393 aa, Homo sapiens
MTTYSDKGAKPERGRFLHFHSVTFWVGNAKQATSFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 770 - protein, 354 aa, Homo sapiens
MGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 771 - protein, 390 aa, Homo sapiens
YSDKGAKPERGRFLHFHSVTFWVGNAKQATSFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 772 - protein, 145 aa, Homo sapiens
MSTEGGGRRCQAQVSRRISFSASHRLYSKFLSDEENLKLFGKCNNPNGHGHNYKVVVTVHGEIDPATGMVMNLADLKKYMEEAIMQPLDHKNLDMDVPYFADVVSTTENVAVYIWDNLQKVLPVGVLYKVKVYETDNNIVVYKGE

SEQ ID NO: 773 - protein, 1427 aa, Homo sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGTPSLVPHEEAAAPGRTTATPAGASLEWSQARGLLFSPAPQPRRLLPGPQENSVQSSACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 774 - protein, 1102 aa, Homo sapiens
MFQLPVNNLGSLRKARKTVKKILSDIGLEYCKEHIEDFKQFEPNDFYLKNTTWEDVGLWDPSLTKNQDYRTKPFCCSACPFSSKFFSAYKSHFRNVHSEDFENRILLNCPYCTFNADKKTLETHIKIFHAPNASAPSSSLSTFKDKNKNDGLKPKQADSVEQAVYYCKKCTYRDPLYEIVRKHIYREHFQHVAAPYIAKAGEKSLNGAVPLGSNAREESSIHCKRCLFMPKSYEALVQHVIEDHERIGYQVTAMIGHTNVVVPRSKPLMLIAPKPQDKKSMGLPPRIGSLASGNVRSLPSQQMVNRLSIPKPNLNSTGVNMMSSVHLQQNNYGVKSVGQGYSVGQSMRLGLGGNAPVSIPQQSQSVKQLLPSGNGRSYGLGSEQRSQAPARYSLQSANASSLSSGQLKSPSLSQSQASRVLGQSSSKPAAAATGPPPGNTSSTQKWKICTICNELFPENVYSVHFEKEHKAEKVPAVANYIMKIHNFTSKCLYCNRYLPTDTLLNHMLIHGLSCPYCRSTFNDVEKMAAHMRMVHIDEEMGPKTDSTLSFDLTLQQGSHTNIHLLVTTYNLRDAPAESVAYHAQNNPPVPPKPQPKVQEKADIPVKSSPQAAVPYKKDVGKTLCPLCFSILKGPISDALAHHLRERHQVIQTVHPVEKKLTYKCIHCLGVYTSNMTASTITLHLVHCRGVGKTQNGQDKTNAPSRLNQSPSLAPVKRTYEQMEFPLLKKRKLDDDSDSPSFFEEKPEEPVVLALDPKGHEDDSYEARKSFLTKYFNKQPYPTRREIEKLAASLWLWKSDIASHFSNKRKKCVRDCEKYKPGVLLGFNMKELNKVKHEMDFDAEWLFENHDEKDSRVNASKTADKKLNLGKEDDSSSDSFENLEEESNESGSPFDPVFEVEPKISNDNPEEHVLKVIPEDASESEEKLDQKEDGSKYETIHLTEEPTKLMHNASDSEVDQDDVVEWKDGASPSESGPGSQQVSDFEDNTCEMKPGTWSDESSQSEDARSSKPAAKKKATMQGDREQLKWKNSSYGKVEGFWSKDQSQWKNASENDERLSNPQIEWQNSTIDSEDGEQFDNMTDGVAEPMHGSLAGVKLSSQQA

SEQ ID NO: 775 - protein, 1102 aa, Homo sapiens; identical to SEQ ID NO: 774

SEQ ID NO: 776 - protein, 1102 aa, Homo sapiens; identical to SEQ ID NO: 774

SEQ ID NO: 777 - protein, 1102 aa, Homo sapiens; identical to SEQ ID NO: 774

SEQ ID NO: 778 - protein, 173 aa, Homo sapiens
MFQLPVNNLGSLRKARKTVKKILSDIGLEYCKEHIEDFKQFEPNDFYLKNTTWEDVGLWDPSLTKNQDYRTKPFCCSACPFSSKFFSAYKSHFRNVHSEDFENRILLNCPYCTFNADKKTLETHIKIFHAPNASAPSSSLSTFKDKNKNDGLKPKQADSVEQAVYYCKKCTYR

SEQ ID NO: 779 - protein, 146 aa, Homo sapiens
MVILTEPEGAPNITANLTSSLLSVCGWSQTINPEDDTDPGHADLVLYITRFDLELPDGNRQVRGVTQLGGACSPTWSCLITEDTGFDLGVTIAHEIGHRICARPSPATQTRWTKAAAAASSFLSWMGQNVAWRSGAPRVAAAPWWS

SEQ ID NO: 780 - protein, 1371 aa, Homo sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 781 - protein, 1340 aa, Homo sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 782 - protein, 223 aa, Homo sapiens
MRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 783 - protein, 344 aa, Homo sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLRPVPPSPLPLLATHLCAGRSLSLGPSQEPAPGGGRGPRTPVPTHKRPRFQTLPSSCPLLRPASSRCTPRD

SEQ ID NO: 784 - protein, 276 aa, Homo sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHRICARPSPATQTRWTKAAAAASSFLSWMGQNVAWRSGAPRVAAAPWWS

SEQ ID NO: 785 - protein, 1427 aa, Homo sapiens; identical to SEQ ID NO: 773

SEQ ID NO: 786 - protein, 364 aa, Homo sapiens
MDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVGGVRAQLMHISWWSRPGLGERDLCARGRWPGGSSD

SEQ ID NO: 787 - protein, 364 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 788 - protein, 364 aa, Homo sapiens; identical to SEQ ID NO: 787

SEQ ID NO: 789 - protein, 418 aa, Homo sapiens
MARRKPEGSSFNMTHLSMAMAFSFPPVASGQLHPQLGNTQHQTELGKELATTSTMPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 790 - protein, 364 aa, Homo sapiens; identical to SEQ ID NO: 787

SEQ ID NO: 791 - protein, 364 aa, Homo sapiens; identical to SEQ ID NO: 787

SEQ ID NO: 792 - protein, 418 aa, Homo sapiens; identical to SEQ ID NO: 789

SEQ ID NO: 793 - protein, 364 aa, Homo sapiens; identical to SEQ ID NO: 787

SEQ ID NO: 794 - protein, 447 aa, Homo sapiens
MSASKIPLFKMKDLILILCLLEMSFAVPFFPQQSGTPGMASLSLETMRQLGSLQRLNTLSQYSRYGFGKSFNSLWMHGLLPPHSSLPWMRPREHETQQYEYSLPVHPPPLPSQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 795 - protein, 432 aa, Homo sapiens
MSASKIPLFKMKDLILILCLLEMSFAVPFFPQQSGTPGMASLSLETMRQLGSLQRLNTLSQYSRYGFGKSFNSLWMHGLLPPHSSLPWMRPREHETQQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 796 - protein, 446 aa, Homo sapiens [sequence omitted]

SEQ ID NO: 797 - protein, 175 aa, Homo sapiens
MGTWILFACLLGAAFAMPVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 798 - protein, 205 aa, Homo sapiens
MGTWILFACLLGAAFAMPLPPHPGHPGYINFSYENSHSQAINVDRTALVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 799 - protein, 191 aa, Homo sapiens
MGTWILFACLLGAAFAMPLPPHPGHPGYINFSYEVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 800 - protein, 192 aa, Homo sapiens
MGTWILFACLVGAAFAMPLPPHPGHPGYINFSYEVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEVD

SEQ ID NO: 801 - protein, 206 aa, Homo sapiens
MGTWILFACLVGAAFAMPLPPHPGHPGYINFSYENSHSQAINVDRIALVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEVD

SEQ ID NO: 802 - protein, 205 aa, Homo sapiens
MGTWILFACLVGAAFAMPLPPHPGHPGYINFSYENSHSQAINVDRIALVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEV

SEQ ID NO: 803 - protein, 1532 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 804 - protein, 1516 aa, Homo sapiens
MAPILSINLFIGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 805 - protein, 1515 aa, Homo sapiens
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 806 - protein, 1532 aa, Homo sapiens; identical to SEQ ID NO: 803

SEQ ID NO: 807 - protein, 1516 aa, Homo sapiens; identical to SEQ ID NO: 804

SEQ ID NO: 808 - protein, 1532 aa, Homo sapiens; identical to SEQ ID NO: 803

SEQ ID NO: 809 - protein, 1532 aa, Homo sapiens; identical to SEQ ID NO: 803

SEQ ID NO: 810 - protein, 223 aa, Homo sapiens
MNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 811 - protein, 805 aa, Homo sapiens [sequence omitted]

SEQ ID NO: 812 - protein, 805 aa, Homo sapiens [sequence omitted]

SEQ ID NO: 813 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQCLAARLEALKENGGARLAEYHAKATEHLSTLSEKAKPALEDLRQGLLPVLESFKVSFLSALEEYTKKLNTQ

SEQ ID NO: 814 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDCARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 815 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 816 - protein, 267 aa, Homo sapiens; identical to SEQ ID NO: 815

SEQ ID NO: 817 - protein, 267 aa, Homo sapiens; identical to SEQ ID NO: 815

SEQ ID NO: 818 - protein, 267 aa, Homo sapiens; identical to SEQ ID NO: 815

SEQ ID NO: 819 - protein, 4563 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSYDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDILEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 820 - protein, 4344 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSYDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDILEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPCF

SEQ ID NO: 821 - protein, 265 aa, Homo sapiens
MKKEVCSVAFLKAVFAEFLATLIFVFFGLGSALKWPSALPTILQIALAFGLAIGTLAQALGPVSGGHINPAITLALLVGNQISLLRAFFYVAAQLVGAIAGAGILYGVAPLNARGNLAVNALNNNTTQGQAMVVELILTFQLALCIFASTDSRRTSPVGSPALSIGLSVTLGHLVGIYFTGCSMNPARSFGPAVVMNRFSPAHWVFWVGPIVGAVLAAILYFYLLFPNSLSLSERVAIIKGTYEPDEDWEEQREERKKTMELTTR

SEQ ID NO: 822 - protein, 330 aa, Homo sapiens
MSAKSRTIGIIGAPFSKGQPRGGVEEGPTVLRKAGLLEKLKEQVTQNFLILECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 823 - protein, 322 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 824 - protein, 236 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVTRTVNTAVAITLACFGLAREGNHKPIDYLNPPK

SEQ ID NO: 825 - protein, 464 aa, Homo sapiens
MASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 826 - protein, 438 aa, Homo sapiens
MASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 827 - protein, 444 aa, Homo sapiens
MASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGREDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 828 - protein, 464 aa, Homo sapiens; identical to SEQ ID NO: 825

SEQ ID NO: 829 - protein, 98 aa, Homo sapiens
MEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVL

SEQ ID NO: 830 - protein, 412 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 831 - protein, 412 aa, Homo sapiens; identical to SEQ ID NO: 830

SEQ ID NO: 832 - protein, 169 aa, Homo sapiens
EPGPLQLMVVAEAQGGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 833 - protein, 412 aa, Homo sapiens; identical to SEQ ID NO: 830

SEQ ID NO: 834 - protein, 412 aa, Homo sapiens; identical to SEQ ID NO: 830

SEQ ID NO: 835 - protein, 198 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENP

SEQ ID NO: 836 - protein, 179 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKVIAPWRMPEFYNRFKGRNDLMEYAKQHGIPIPVTPKNPWSMDENLMHISYEAGILENP

SEQ ID NO: 837 - protein, 220 aa, Homo sapiens
MELGLGGLSTLSHCPWPRQQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 838 - protein, 220 aa, Homo sapiens; identical to SEQ ID NO: 837

SEQ ID NO: 839 - protein, 228 aa, Homo sapiens
MELGLGGLSTLSHCPWPRQQAPLGLSAQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 840 - protein, 66 aa, Homo sapiens
MELGLGGLSTLSHCPWPRQQPALWPTLAALALLSSVAEASLGSAPRSPAPREGPPPVLASPAGHLP

SEQ ID NO: 841 - protein, 89 aa, Homo sapiens
MELGLGGLSTLSHCPWPRQQAPLGLSAQPALWPTLAALALLSSVAEASLGSAPRSPAPREGPPPVLASPAGHLPGGRTARWCSGRARRP

SEQ ID NO: 842 - protein, 66 aa, Homo sapiens; identical to SEQ ID NO: 840

SEQ ID NO: 843 - protein, 89 aa, Homo sapiens; identical to SEQ ID NO: 841

SEQ ID NO: 844 - protein, 228 aa, Homo sapiens; identical to SEQ ID NO: 839

SEQ ID NO: 845 - protein, 533 aa, Homo sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 846 - protein, 533 aa, Homo sapiens; identical to SEQ ID NO: 845

SEQ ID NO: 847 - protein, 413 aa, Homo sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPYWPECSLLL

SEQ ID NO: 848 - protein, 45 aa, Homo sapiens
MGPRGAASLPRGPGPRRLLLPVVLPLLLLLLLAPPGSGAGASRPP

SEQ ID NO: 849 - protein, 595 aa, Homo sapiens
MAGPSPPLRAGVGRRLLGVAHPDLRPCLCGELQVEGGPGPVPGMLRTCYVRSPWRRGPSSARGEQSGSGHLEQEEVQSGSLLFRLLLFLSRSPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCP

SEQ ID NO: 850 - protein, 579 aa, Homo sapiens
MARAVGPERRLLAVYTGGTIGMRSELGVLVPGTGLAAILRTLPMFHDEEHARARGLSEDTLVLPPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEPSCFQEVLPGV

SEQ ID NO: 851 - protein, 140 aa, Homo sapiens
AAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEPSCFQEVLPGV

SEQ ID NO: 852 - protein, 573 aa, Homo sapiens
MARAVGPERRLLAVYTGGTIGMRSELGVLVPGTGLAAILRTLPMFHDEEHARARGLSEDTLVLPPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEVLPGV

SEQ ID NO: 853 - protein, 313 aa, Homo sapiens
MTSCHIAEEHIQKVAIFGGTHGNELTGVFLVKHWLENGAEIQRTGLEVKPFITNPRAVKKCTRYIDCDLNRIFDLENLGKKMSEDLPYEVRRAQEINHLFGPKDSEDSYDIIFDLHNTTSNMGCTLILEDSRNNFLIQMFHYIKTSLAPLPCYVYLIEHPSLKYATTRSIAKYPVGIEVGPQPQGVLRADILDQMRKMIKHALDFIHHFNEGKEFPPCAIEVYKIIEKVDYPRDENGEIAAIIHPNLQDQDWKPLHPGDPMFLTLDGKTIPLGGDCTVYPVFVNEAAYYEKKEAFAKTTKLTLNAKSIRCCLH

SEQ ID NO: 854 - protein, 313 aa, Homo sapiens; identical to SEQ ID NO: 853

SEQ ID NO: 855 - protein, 1251 aa, Homo sapiens
MSTERDSETTFDEDSQPNDEVVPYSDDETEDELDDQGSAVEPEQNRVNREAEENREPFRKECTWQVKANDRKYHEQPHFMNTKFLCIKESKYANNAIKTYKYNAFTFIPMNLFEQFKRAANLYFLALLILQAVPQISTLAWYTTLVPLLVVLGVTAIKDLVDDVARHKMDKEINNRTCEVIKDGRFKVAKWKEIQVGDVIRLKKNDFVPADILLLSSSEPNSLCYVETAELDGETNLKFKMSLEITDQYLQREDTLATFDGFIECEEPNNRLDKFTGTLFWRNTSFPLDADKILLRGCVIRNTDFCHGLVIFAGADTKIMKNSGKTRFKRTKIDYLMNYMVYTIFVVLILLSAGLAIGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKEIEEKEFTEWNKKFMAASVASTNRDEALDKVYEEIEKDLILLGATAIEDKLQDGVPETISKLAKADIKIWVLTGDKKETAENIGFACELLTEDTTICYGEDINSLLHARMENQRNRGGVYAKFAPPVQESFFPPGGNRALIITGSWLNEILLEKKTKRNKILKLKFPRTEEERRMRTQSKRRLEAKKEQRQKNFVDLACECSAVICCRVTPKQKAMVVDLVKRYKKAITLAIGDGANDVNMIKTAHIGVGISGQEGMQAVMSSDYSFAQFRYLQRLLLVHGRWSYIRMCKFLRYFFYKNFAFTLVHFWYSFFNGYSAQTAYEDWFITLYNVLYTSLPVLLMGLLDQDVSDKLSLRFPGLYIVGQRDLLFNYKRFFVSLLHGVLTSMILFFIPLGAYLQTVGQDGEAPSDYQSFAVTIASALVITVNFQIGLDTSYWTFVNAFSIFGSIALYFGIMFDFHSAGIHVLFPSAFQFTGTASNALRQPYIWLTIILAVAVCLLPVVAIRFLSMTIWPSESDKIQKHRKRLKAEEQWQRRQQVFRRGVSTRRSAYAFSHQRGYADLISSGRSIRKKRSPLDAIVADGTAEYRRTGDS

SEQ ID NO: 856 - protein, 1251 aa, Homo sapiens; identical to SEQ ID NO: 855

SEQ ID NO: 857 - protein, 1465 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 858 - protein, 1258 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIESKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 859 - protein, 1354 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 860 - protein, 1035 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 861 - protein, 676 aa, Homo sapiens
MDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 862 - protein, 1400 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 863 - protein, 1387 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 864 - protein, 528 aa, Homo sapiens
MKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAAPRWVVLLRSGLQISETQVSQHGRAHRPGHKHCLCLFSGHPGGCCG

SEQ ID NO: 865 - protein, 1321 aa, Homo sapiens
MSDSVILRSIKKFGEENDGFESDKSYNNDKKSRLQDEKKGDGVRVGFFQLFRFSSSTDIWLMFVGSLCAFLHGIAQPGVLLIFGTMTDVFIDYDVELQELQIPGKACVNNTIVWTNSSLNQNMTNGTRCGLLNIESEMIKFASYYAGIAVAVLITGYIQICFWVIAAARQIQKMRKFYFRRIMRMEIGWFDCNSVGELNTRFSDDINKINDAIADQMALFIQRMTSTICGFLLGFFRGWKLTLVIISVSPLIGIGAATIGLSVSKFTDYELKAYAKAGVVADEVISSMRTVAAFGGEKREVERYEKNLVFAQRWGIRKGIVMGFFTGFVWCLIFLCYALAFWYGSTLVLDEGEYTPGTLVQIFLSVIVGALNLGNASPCLEAFATGRAAATSIFETIDRKPIIDCMSEDGYKLDRIKGEIEFHNVTFHYPSRPEVKILNDLNMVIKPGEMTALVGPSGAGKSTALQLIQRFYDPCEGMVTVDGHDIRSLNIQWLRDQIGIVEQEPVLFSTTIAENIRYGREDATMEDIVQAAKEANAYNFIMDLPQQFDTLVGEGGGQMSGGQKQRVAIARALIRNPKILLLDMATSALDNESEAMVQEVLSKIQHGHTIISVAHRLSTVRAADTIIGFEHGTAVERGTHEELLERKGVYFTLVTLQSQGNQALNEEDIKDATEDDMLARTFSRGSYQDSLRASIRQRSKSQLSYLVHEPPLAVVDHKSTYEEDRKDKDIPVQEEVEPAPVRRILKFSAPEWPYMLVGSVGAAVNGTVTPLYAFLFSQILGTFSIPDKEEQRSQINGVCLLFVAMGCVSLFTQFLQGYAFAKSGELLTKRLRKFGFRAMLGQDIAWFDDLRNSPGALTTRLATDASQVQGAAGSQIGMIVNSFTNVTVAMIIAFSFSWKLSLVILCFFPFLALSGATQTRMLTGFASRDKQALEMVGQITNEALSNIRTVAGIGKERRFIEALETELEKPFKTAIQKANIYGFCFAFAQCIMFIANSASYRYGGYLISNEGLHFSYVFRVISAVVLSATALGRAFSYTPSYAKAKISAARFFQLLDRQPPISVYNTAGEKWDNFQGKIDFVDCKFTYPSRPDSQVLNGLSVSISPGQTLAFVGSSGCGKSTSIQLLERFYDPDQGKVMIDGHDSKKVNVQFLRSNIGIVSQEPVLFACSIMDNIKYGDNTKEIPMERVIAAAKQAQLHDFVMSLPEKYETNVGSQGSQLSRGEKQRIAIARAIVRDPKILLLDEATSALDTESEKTVQVALDKAREGRTCIVIAHRLSTIQNADIIAVMAQGVVIEKGTHEELMAQKGAYYKLVTTGSPIS

SEQ ID NO: 866 - protein, 1286 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVFVDFGFQLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 867 - protein, 1232 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 868 - protein, 1279 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 869 - protein, 61 aa, Homo sapiens
MDLEAAKNGTAWRPTSAEGDFELGISSKQKRKKTKTVKMIGVLTLFRYSDWQDKLFMSLGT

SEQ ID NO: 870 - protein, 1232 aa, Homo sapiens; identical to SEQ ID NO: 867

SEQ ID NO: 871 - protein, 1279 aa, Homo sapiens; identical to SEQ ID NO: 868

SEQ ID NO: 872 - protein, 487 aa, Homo sapiens
MRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSELQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 873 - protein, 482 aa, Homo sapiens
MDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 874 - protein, 370 aa, Homo sapiens
MDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPPPPPRSPACPRCCRPLPRRRAPPPRPSCRTRWRPLGRRTPSTRTAAPTCPSPGPASRGTRRALLRKIPRSQERKLPESLRPEGRRFKQSEKLKYP

SEQ ID NO: 875 - protein, 396 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 876 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 877 - protein, 365 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 878 - protein, 1500 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 879 - protein, 121 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYL

SEQ ID NO: 880 - protein, 1506 aa, Homo sapiens
MPQIIKMTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 881 - protein, 1049 aa, Homo sapiens
MKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 882 - protein, 121 aa, Homo sapiens; identical to SEQ ID NO: 879

SEQ ID NO: 883 - protein, 513 aa, Homo sapiens [sequence omitted]

SEQ ID NO: 884 - protein, 1508 aa, Homo sapiens
RPRPQIIKMTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 885 - protein, 70 aa, Homo sapiens
MTRILTAFKVVRTLKTGFGFTNVTAHQKWKFSRPGIRLLSVKAQTAHIVLEDRDADTPAPLLNQPEPHVI

SEQ ID NO: 886 - protein, 201 aa, Homo sapiens
MSRREGSLEDPQTDSSVSLLPHLEAKIRQTHSLAHLLTKYAEQLLQEYVQLQGDPFGLPSFSPPRLPVAGLSAPAPSHAGLPVHERLRLDAAALAALPPLLDAVCRRQAELNPRAPRLLRRLEDAARQARALGAAVEALLAALGAANRGPRAEPPAATASAASATGVFPAKVLGLRVCGLYREWLSRTEGDLGQLLPGGSA

SEQ ID NO: 887 - protein, 200 aa, Homo sapiens
MSRREGSLDPQTDSSVSLLPHLEAKIRQTHSLAHLLTKYAEQLLQEYVQLQGDPFGLPSFSPPRLPVAGLSAPAPSHAGLPVHERLRLDAAALAALPPLLDAVCRRQAELNPRAPRLLRRLEDAARQARALGAAVEALLAALGAANRGPRAEPPAATASAASATGVFPAKVLGLRVCGLYREWLSRTEGDLGQLLPGGSA

SEQ ID NO: 888 - protein, 170 aa, Homo sapiens
MKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 889 - protein, 170 aa, Homo sapiens; identical to SEQ ID NO: 888

SEQ ID NO: 890 - protein, 184 aa, Homo sapiens
MADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 891 - protein, 1065 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVEPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 892 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 893 - protein, 622 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 894 - protein, 64 aa, Homo sapiens [sequence omitted]

SEQ ID NO: 895 - protein, 583 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPSLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 896 - protein, 295 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 897 - protein, 238 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKYSTSLELWYLWSSSLSSSWLYLYTSVERQEWGRAGRRTPH

SEQ ID NO: 898 - protein, 461 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 899 - protein, 423 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 900 - protein, 2229 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRQGIQRAADIEQQAVFAVFDENKSWYLEDNINKFCENPDEVKRDDPKFYESNIMSNFTLSAINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 901 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRQGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 902 - protein, 332 aa, Homo sapiens [sequence omitted]

SEQ ID NO: 903 - protein, 444 aa, Homo sapiens
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 904 - protein, 466 aa, Homo sapiens
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 905 - protein, 397 aa, Homo sapiens
MGNVNRQGQHCRDFIMVSQALRLLCLLLGLQGCLAADGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 906 - protein, 216 aa, Homo sapiens
MRIQDPGKVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 907 - protein, 2351 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 908 - protein, 332 aa, Homo sapiens
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKGTGTRSRRRAVRRCTRWRWSSSTTGSQRRPMTSTSPCSGSRPPSPSA

SEQ ID NO: 909 - protein, 488 aa, Homo sapiens
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 910 - protein, 334 aa, Homo sapiens
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRGTGTRSRRRAVRRCTRWRWSSSTTGSQRRPMTSTSPCSGSRPPSPSA

SEQ ID NO: 911 - protein, 573 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISVNNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 912 - protein, 625 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 913 - protein, 210 aa, Homo sapiens
  MOD_RES (1)..(1): Any amino acid
XSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNELRGAPMKISGWLKTS

SEQ ID NO: 914 - protein, 732 aa, Homo sapiens
MSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVEFTNPLKETLRNVWVHLDGPGVTRPMKKMFREIRPNSTVQWEEVCRPWVSGHRKLIASMSSDSLRHVYGELDVQIQRRPSM

SEQ ID NO: 915 - protein, 138 aa, Homo sapiens
MSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMR

SEQ ID NO: 916 - protein, 626 aa, Homo sapiens
MSETSRTAFGGRRAVPPNNSNAAEDDLPTVELQGVVPRGVNLQGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTEVCRPWVSGHRKLIASMSSDSLRHVYGELDVQIQRRPSM

SEQ ID NO: 917 - protein, 2944 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 918 - protein, 2912 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 919 - protein, 144 aa, Homo sapiens
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 920 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 921 - protein, 200 aa, Homo sapiens
MSPEPALSPALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 922 - protein, 171 aa, Homo sapiens
MAGPATQSPMKLMALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 923 - protein, 204 aa, Homo sapiens
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 924 - protein, 1231 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 925 - protein, 449 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVIFQL

SEQ ID NO: 926 - protein, 449 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVSFTL

SEQ ID NO: 927 - protein, 190 aa, Homo sapiens
MAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPVAIIELELGKYGQESEFLCLEFDEVKVNQILKTLSEVEESISTLISQPN

SEQ ID NO: 928 - protein, 38 aa, Homo sapiens
  MOD_RES (1)..(1): Any amino acid
XQESEFLCLEFDEVKVNQILKTLSEVEESISTLISQPN

SEQ ID NO: 929 - protein, 32 aa, Homo sapiens
  MOD_RES (1)..(1): Any amino acid
XCLEFDEVKVNQILKTLSEVEESISTLISQPN

SEQ ID NO: 930 - protein, 38 aa, Homo sapiens; identical to SEQ ID NO: 928
  MOD_RES (1)..(1): Any amino acid

SEQ ID NO: 931 - protein, 159 aa, Homo sapiens
MAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPVAIIELELGKYGQVHCNQ

SEQ ID NO: 932 - protein, 196 aa, Homo sapiens
MRLPLLVSAGVLLVALLPCPPCRALLSRGPVPGARQAPQHPQPLDFFQPPPQSEQPQQPQARPVLLRMGEEYFLRLGNLNKSPAAPLSPASSLLAGGSGSRPSPEQATANFFRVLLQQLLLPRRSLDSPAALAERGARNALGGHQEAPERERRSEEPPISLDLTFHLLREVLEMARAEQLAQQAHSNRKLMEIIGK

SEQ ID NO: 933 - protein, 1480 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 934 - protein, 1438 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALK

SEQ ID NO: 935 - protein, 1419 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEETSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 936 - protein, 190 aa, Homo sapiens
  MOD_RES (1)..(1): Any amino acid
XKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVRFEHCLLC

SEQ ID NO: 937 - protein, 400 aa, Homo sapiens
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVTTWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGLQAARTGSGSRLRQDWAPSLQPKALPQTTSVSASSLKG

SEQ ID NO: 938 - protein, 367 aa, Homo sapiens
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVTTWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGYDQLN

SEQ ID NO: 939 - protein, 220 aa, Homo sapiens
MNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVTTWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGYDQLN

SEQ ID NO: 940 - protein, 292 aa, Homo sapiens
MCPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVTTWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGLQAARTGSGSRLRQDWAPSLQPKALPQTTSVSASSLKG

SEQ ID NO: 941 - protein, 75 aa, Homo sapiens
MIRNWLTIFILFPLKLVEKCESSVSLTVPPVVKLENGSSTNVSLTLRPPLNATLVITFEITFRSKNITILELPDE

SEQ ID NO: 942 - protein, 67 aa, Homo sapiens
MRIHYLLFALLFLFLVPVPGHGGIINTLQKYYCRVRGGRCAVLSCLPKEEQIGKCSTRGRKCCRRKK

SEQ ID NO: 943 - protein, 67 aa, Homo sapiens; identical to SEQ ID NO: 942

SEQ ID NO: 944 - protein, 64 aa, Homo sapiens
MRVLYLLFSFLFIFLMPLPGVFGGIGDPVTCLKSGAICHPVFCPRRYKQIGTCGLPGTKCCKKP

SEQ ID NO: 945 - protein, 64 aa, Homo sapiens; identical to SEQ ID NO: 944

SEQ ID NO: 946 - protein, 282 aa, Homo sapiens [sequence omitted]

SEQ ID NO: 947 - protein, 282 aa, Homo sapiens [sequence omitted]

SEQ ID NO: 948 - protein, 187 aa, Homo sapiens
MHQTPITTWSVSHWDGTAIRSATCSCTGLTRCLRWTATTTMMAASPAGTTPSTESQPLSGSSPGSQDVMLMGDFNAGCSYVRPSQWSSIRLWTSPTFQWLIPDSADTTATPTHCAYDRIVVAGMLLRGAVVPDSALPFNFQAAYGLSDQLFSVHTCSGAGLGERHGLPASAALPSNTCRAGTHRVST

SEQ ID NO: 949 - protein, 2080 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 950 - protein, 2081 aa, Homo sapiens
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 951 - protein, 2102 aa, Homo sapiens
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 952 - protein, 2118 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 953 - protein, 2112 aa, Homo sapiens
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 954 - protein, 2088 aa, Homo sapiens
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 955 - protein, 2097 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 956 - protein, 2119 aa, Homo sapiens
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 957 - protein, 2098 aa, Homo sapiens
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 958 - protein, 2111 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 959 - protein, 2101 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 960 - protein, 148 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQDFDYIISFSYGLQGFC

SEQ ID NO: 961 - protein, 391 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 962 - protein, 389 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVYYINFTDFASYEVVVDEKPFLQCTRSIETGKTNYNTCYTAGVCLLKARQKIAVKMVHADISINMSKHTTFFGAIRLGEAPAS

SEQ ID NO: 963 - protein, 135 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQGHQ

SEQ ID NO: 964 - protein, 386 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNGGVLNDWSRITMNPKVFKLHPRSGELEVLVDGTYFIYSQVYYINFTDFASYEVVVDEKPFLQCTRSIETGKTNYNTCYTAGVCLLKARQKIAVKMVHADISINMSKHTTFFGAIRLGEAPAS

SEQ ID NO: 965 - protein, 148 aa, Homo sapiens; identical to SEQ ID NO: 960

SEQ ID NO: 966 - protein, 1142 aa, Homo sapiens
MLVLRCRLGTSFPKLDNLVPKGKMKILLVFLGLLGNSVAMPMHMPRMPGFSSKSEEMMRYNQFNFMNGPHMAHLGPFFGNGLPQQFPQYQMPMWPQPPPNTWHPRKSSAPKRHNKTDQTQETQKPNQTQSKKPPQKRPLKQPSHNQPQPEEEAQPPQAFPPFGNGLFPYQQPPWQIPQRLPPPGYGRPPISNEEGGNPYFGYFGYHGFGGRPPYYSEEMFEQDFEKPKEEDPPKAESPGTEPTANSTVTETNSTQPNPKGSQGGNDTSPTGNSTPGLNTGNNPPAQNGIGPLPAVNASGQGGPGSQIPWRPSQPNIRENHPYPNIRNFPSGRQWYFTGTVMGHRQNRPFYRNQQVQRGPRWNFFAWERKQVARPGNPVYHKAYPPTSRGNYPNYAGNPANLRRKPQGPNKHPVGTTVAPLGPKPGPVVRNEKIQNPKEKPLGPKEQIIVPTKNPTSPWRNSQQYEVNKSNYKLPHSEGYMPVPNFNSVDQHENSYYPRGDSRKVPNSDGQTQSQNLPKGIVLGSRRMPYESETNQSELKHSSYQPAVYPEEIPSPAKEHFPAGRNTWDHQEISPPFKEDPGRQEEHLPHPSHGSRGSVFYPEYNPYDPRENSPYLRGNTWDERDDSPNTMGQKESPLYPINTPDQKEIVPYNEEDPVDPTGDEVFPGQNRWGEELSFKGGPTVRHYEGEQYTSNQPKEYLPYSLDNPSKPREDFYYSEFYPWSPDENFPSYNTASTMPPPIESRGYYVNNAAGPEESTLFPSRNSWDHRIQAQGQRERRPYFNRNIWDQATHLQKAPARPPDQKGNQPYYSNTPAGLQKNPIWHEGENLNYGMQITRMNSPEREHSSFPNFIPPSYPSGQKEAHLFHLSQRGSCCAGSSTGPKDNPLALQDYTPSYGLAPGENQDTSPLYTDGSHTKQTRDIISPTSILPGQRNSSEKRESQNPFRDDVSTLRRNTPCSIKNQLGQKEIMPFPEASSLQSKNTPCLKNDLGGDGNNILEQVFEDNQLNERTVDLTPEQLVIGTPDEGSNPEGIQSQVQENESERQQQRPSNILHLPCFGSKLAKHHSSTTGTPSSDGRQSPFDGDSITPTENPNTLVELATEEQFKSINVDPLDADEHSPFEFLQRGTNVQDQVQDCLLLQA

SEQ ID NO: 967 - protein, 193 aa, Homo sapiens
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 968 - protein, 63 aa, Homo sapiens
MPSSVSWGILLLAGLCCLVPVSLAHGEGTFTSDLSKQMEEEAVRLFIEWLKNGGPSSGAPPPS

SEQ ID NO: 969 - protein, 349 aa, Homo sapiens
MEAVKAEAWEGAAVAQDLLALGYGGVPGAASRGASCPDFRGLCVRLAAELATLGALEQQREAGAEVLSAGDGPGAEEDFLRQLGSLLRELHCPDRALCGGDGAAALREPGAGLRLLRFLCSELQATRLLCLRSLLDPSPRPPLGEGVVEGAGMVQELDLTLQALGLPRPAPGTPASQLLQELHAKISELQPSLPPGSLQPLLSCSLDAPRWEALESLSQSLRDQYRCRRCLLLKRLDLTTSAFHWSDRAEAQGEAMRAVLIPIREVLTPESDISIAHVLAARADLSCLVPATSVAVRRGTCCAINKVLMGNVPDRGGRPNELEPPMPTWRSRREDGGPQCWGRKKKKKK

SEQ ID NO: 970 - protein, 267 aa, Homo sapiens
MEAVKAEAWEGAAVAQDLLALGYGGVPGAASRGASCPDFRGLCVRLAAELATLGALEQQREAGAEVLSAGDGPGAEEDFLRQLGSLLRELHCPDRALCGGDGAAALREPGAGLRLLRFLCSELQATRLLCLRSLLDPSPRPPLGEGVVEGAGMVQELDLTLQALGLPRPAPGTPASQLLQELHAKEALESLSQSLRDQYRCRRCLLLKRLDLTTSAFHWSDRAEVLMGNVPDRGGRPNELEPPMPTWRSRREDGGPQCWGRKKKKKK

SEQ ID NO: 971 - protein, 866 aa, Homo sapiens
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENCAEVYGGGWWYNNCQAANLNGIYYPGGSYDPRNNSPYEIENGVVWVSFRGADYSLRAVRMKIRPLVTQ

SEQ ID NO: 972 - protein, 644 aa, Homo sapiens
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRGIHTSPLGKPSLSP

SEQ ID NO: 973 - protein, 289 aa, Homo sapiens
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPVVNLQVTANNLLVARVTTEETPHLKARAIKWQMRPEVKPIMKEHIAPREAMLNLALSEVSTLLLWGSLPCPPRLS

SEQ ID NO: 974 - protein, 491 aa, Homo sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 975 - protein, 474 aa, Homo sapiens
MKRMVSWSFHKLKTMKHLLLLLLCVFLVKSQGVNDNEEGFFSARGHRPLDKKREEARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 976 - protein, 453 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 977 - protein, 437 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 978 - protein, 209 aa, Homo sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 979 - protein, 209 aa, Homo sapiens; identical to SEQ ID NO: 978

SEQ ID NO: 980 - protein, 106 aa, Homo sapiens
MLRFIQEVNTTTRSCALWDLEEDTEYIVHVQAISIQGQSPASEPVLFKTPREAEKMASKNKDEVTMKEMGRNQQLRTGEVLIIVVVLFMWAGVIALFCRQYDIIEA

SEQ ID NO: 981 - protein, 137 aa, Homo sapiens
MLRFIQEVNTTTRSCALWDLEEDTEYIVHVQAISIQGQSPASEPVLFKTPREAEKMASKNKDEVTMKEMGRNQQLRTGEVLIIVVVLFMWAGVIALFCRQYDIIKDNEPNNNKEKTKSASETSTPEHQGGGLLRSKI

SEQ ID NO: 982 - protein, 129 aa, Homo sapiens
MKTLQFFFLFCCWKAICCNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKE

SEQ ID NO: 983 - protein, 129 aa, Homo sapiens; identical to SEQ ID NO: 982

SEQ ID NO: 984 - protein, 129 aa, Homo sapiens; identical to SEQ ID NO: 982

SEQ ID NO: 985 - protein, 419 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 986 - protein, 419 aa, Homo sapiens; identical to SEQ ID NO: 985

SEQ ID NO: 987 - protein, 419 aa, Homo sapiens; identical to SEQ ID NO: 985

SEQ ID NO: 988 - protein, 392 aa, Homo sapiens
MAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPAAPLPGFSAVVVSSVPLGGGLSSSASLEVATYTFLQQLCPDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 989 - protein, 400 aa, Homo sapiens
MAALRQPQVAELLAEARRAFREEFGAEPELAVSAPGRVNLIGEHTDYNQGLVLPMRDRLFPTLEGRKRGSGRERVRGRLLAQARPLGAGAPRLQPGSMFPLNCEALCATQKGTLRASGHRGAPTADLGERSLLAQPVQFTEEETGGAFRPICSLGSAQASSPPCPTAQGRVQDGLVSLLTTSEGADEPQRLQFPLPTAQRSLEPGTPRWANYVKGVIQYYPAAPLPGFSAVVVSSVPLGGGLSSSASLEVATYTFLQQLCPDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTADGAKVLCL

SEQ ID NO: 990 - protein, 422 aa, Homo sapiens
MCAPPRGAPPEHPAPTGLCRSSCAELQARVMAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPAAPLPGFSAVVVSSVPLGGGLSSSASLEVATYTFLQQLCPDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 991 - protein, 392 aa, Homo sapiens; identical to SEQ ID NO: 988

SEQ ID NO: 992 - protein, 522 aa, Homo sapiens
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 993 - protein, 86 aa, Homo sapiens
MAAVVAATRWWQLLLVLSAAGMGASGAPQPPNILLLLMDDRGRHCSQDGYPSAMASTPPTPMPETPTHRRRLWAASQTRSSSCRSF

SEQ ID NO: 994 - protein, 447 aa, Homo sapiens
MAAVVAATRWWQLLLVLSAAGMGASGAPGQRAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 995 - protein, 379 aa, Homo sapiens
MSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 996 - protein, 270 aa, Homo sapiens
MTLSTLCVLGPSEPTESKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 997 - protein, 84 aa, Homo sapiens
MSRSGTDPQQRQQASEADAAAATFRANDHQHIRYNPLQDEWVLVSAHRMKRPWQGQVEPQLLKTVPRHDPLNPLCPGAIRANGE

SEQ ID NO: 998 - protein, 429 aa, Homo sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 999 - protein, 15 aa, Homo sapiens
PQNSKIPGPTFLDPH

SEQ ID NO: 1000 - protein, 16 aa, Homo sapiens
ANTPCGPYTHDCPVKR

SEQ ID NO: 1001 - protein, 211 aa, Homo sapiens
MKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 1002 - protein, 185 aa, Homo sapiens
MKLWDVVAVCLVLLHTASAFPLPAANMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 1003 - protein, 228 aa, Homo sapiens
MQSLPNSNGAAAGRDFKMKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 1004 - protein, 61 aa, Homo sapiens
MKLWDVVAVCLVLLHTASAFPLPAANMPEDYPDQFDDVMDFIQATIKRLKRSPDKQMAVLP

SEQ ID NO: 1005 - protein, 61 aa, Homo sapiens; identical to SEQ ID NO: 1004

SEQ ID NO: 1006 - protein, 185 aa, Homo sapiens; identical to SEQ ID NO: 1002

SEQ ID NO: 1007 - protein, 202 aa, Homo sapiens
MQSLPNSNGAAAGRDFKMKLWDVVAVCLVLLHTASAFPLPAANMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 1008 - protein, 180 aa, Homo sapiens
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 1009 - protein, 180 aa, Homo sapiens; identical to SEQ ID NO: 1008

SEQ ID NO: 1010 - protein, 753 aa, Homo sapiens
RAPDRRGSPRLASTRLGALRLRPSRRVPARAPAPAQAPLPLGPRLLGLRRNMAAPMTPAARPEDYEAALNAALADVPELARLLEIDPYLKPYAVDFQRRYKQFSQILKNIGENEGGIDKFSRGYESFGVHRCADGGLYCKEWAPGAEGVFLTGDFNGWNPFSYPYKKLDYGKWELYIPPKQNKSVLVPHGSKLKVVITSKSGEILYRISPWAKYVVREGDNVNYDWIHWDPEHSYEFKHSRPKKPRSLRIYESHVGISSHEGKVASYKHFTCNVLPRIKGLGYNCIQLMAIMEHAYYASFGYQITSFFAASSRYGTPEELQELVDTAHSMGIIVLLDVVHSHASKNSADGLNMFDGTDSCYFHSGPRGTHDLWDSRLFAYSSWEILRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQAYVSEKHEGNKIIAFERAGLLFIFNFHPSKSYTDYRVGTALPGKFKIVLDSDAAEYGGHQRLDHSTDFFSEAFEHNGRPYSLLVYIPSRVALILQNVDLPN

SEQ ID NO: 1011 - protein, 702 aa, Homo sapiens
MAAPMTPAARPEDYEAALNAALADVPELARLLEIDPYLKPYAVDFQRRYKQFSQILKNIGENEGGIDKFSRGYESFGVHRCADGGLYCKEWAPGAEGVFLTGDFNGWNPFSYPYKKLDYGKWELYIPPKQNKSVLVPHGSKLKVVITSKSGEILYRISPWAKYVVREGDNVNYDWIHWDPEHSYEFKHSRPKKPRSLRIYESHVGISSHEGKVASYKHFTCNVLPRIKGLGYNCIQLMAIMEHAYYASFGYQITSFFAASSRYGTPEELQELVDTAHSMGIIVLLDVVHSHASKNSADGLNMFDGTDSCYFHSGPRGTHDLWDSRLFAYSSWEILRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQAYVSEKHEGNKIIAFERAGLLFIFNFHPSKSYTDYRVGTALPGKFKIVLDSDAAEYGGHQRLDHSTDFFSEAFEHNGRPYSLLVYIPSRVALILQNVDLPN

SEQ ID NO: 1012 - protein, 465 aa, Homo sapiens
MAIMEHAYYASFGYQITSFFAASSRYGTPEELQELVDTAHSMGIIVLLDVVHSHASKNSADGLNMFDGTDSCYFHSGPRGTHDLWDSRLFAYSSWEILRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQAYVSEKHEGNKIIAFERAGLLFIFNFHPSKSYTDYRVGTALPGKFKIVLDSDAAEYGGHQRLDHSTDFFSEAFEHNGRPYSLLVYIPSRVALILQNVDLPN

SEQ ID NO: 1013 - protein, 357 aa, Homo sapiens
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLAQVLGQPHKKSL

SEQ ID NO: 1014 - protein, 952 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPHVHSRAPSPLYSVEFSEEPFGVIVRRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPVEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 1015 - protein, 952 aa, Homo sapiens; identical to SEQ ID NO: 1014

SEQ ID NO: 1016 - protein, 536 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 1017 - protein, 536 aa, Homo sapiens; identical to SEQ ID NO: 1016

SEQ ID NO: 1018 - protein, 521 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 1019 - protein, 487 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 1020 - protein, 449 aa, Homo sapiens
MELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 1021 - protein, 493 aa, Homo sapiens
MTLRGWSFQVLPESNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 1022 - protein, 423 aa, Homo sapiens
MEFSSPSREECPKPLSRVSIMAGSLTGLLLLQAVSWASGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 1023 - protein, 703 aa, Homo sapiens
MLRGRSLSVTSLGGLPQWEVEELPVEELLLFEVAWEVTNKVGGIYTVIQTKAKTTADEWGENYFLIGPYFEHNMKTQVEQCEPVNDAVRRAVDAMNKHGCQVHFGRWLIEGSPYVVLFDIGYSAWNLDRWKGDLWEACSVGIPYHDREANDMLIFGSLTAWFLKEVTDHADGKYVVAQFHEWQAGIGLILSRARKLPIATIFTTHATLLGRYLCAANIDFYNHLDKFNIDKEAGERQIYHRYCMERASVHCAHVFTTVSEITAIEAEHMLKRKPDVVTPNGLNVKKFSAVHEFQNLHAMYKARIQDFVRGHFYGHLDFDLEKTLFLFIAGRYEFSNKGADIFLESLSRLNFLLRMHKSDITVMVFFIMPAKTNNFNVETLKGQAVRKQLWDVAHSVKEKFGKKLYDALLRGEIPDLNDILDRDDLTIMKRAIFSTQRQSLPPVTTHNMIDDSTDPILSTIRRIGLFNNRTDRVKVILHPEFLSSTSPLLPMDYEEFVRGCHLGVFPSYYEPWGYTPAECTVMGIPSVTTNLSGFGCFMQEHVADPTAYGIYIVDRRFRSPDDSCNQLTKFLYGFCKQSRRQRIIQRNRTERLSDLLDWRYLGRYYQHARHLTLSRAFPDKFHVELTSPPTTEGFKYPRPSSVPPSPSGSQASSPQSSDVEDEVEDERYDEEEEAERDRLNIKSPFSLSHVPHGKKKLHGEYKN

SEQ ID NO: 1024 - protein, 116 aa, Homo sapiens
MDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 1025 - protein, 217 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 1026 - protein, 122 aa, Homo sapiens
MATGSRTSLLLAFGLLCLPWLQEGSAFPTIPLSRLFDNAMLRAHRLHQLAFDTYQEFRLEDGSPRTGQIFKQTYSKFDTNSHNDDALLKNYGLLYCFRKDMDKVETFLRIVQCRSVEGSCGF

SEQ ID NO: 1027 - protein, 177 aa, Homo sapiens
MATGSRTSLLLAFGLLCLPWLQEGSAFPTIPLSRLFDNAMLRAHRLHQLAFDTYQEFNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 1028 - protein, 202 aa, Homo sapiens
MATGSRTSLLLAFGLLCLPWLQEGSAFPTIPLSRLFDNAMLRAHRLHQLAFDTYQEFNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 1029 - protein, 256 aa, Homo sapiens
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWVRVAPGIPNPGAPLASRDWGEKHCCPLFSSQALTQENSPYSSFPLVNPPGLSLQPGGEGGKWMNERGREQCPSAWPLLLFLHFAEAGRWQPPDWADLQSVLQQV

SEQ ID NO: 1030 - protein, 217 aa, Homo sapiens
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 1031 - protein, 202 aa, Homo sapiens
MAAGSRTSLLLAFGLLCLSWLQEGSAFPTIPLSRLFDNAMLRARRLYQLAYDTYQEFNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 1032 - protein, 245 aa, Homo sapiens
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLIGWKMAAPGLGRSSISPTASLTQNRTTMTHCSRTTGCSTASGRTWTRSRHSCASCSAALWRAAVASSCPGGIPVTPPQCLSWSWKVLLQCPPALS

SEQ ID NO: 1033 - protein, 250 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATHMCMVMRGVQKMNSKTVTSTMLGVFREDPKTREEFLTLIRS

SEQ ID NO: 1034 - protein, 230 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATKSNKYNKGLSYFLLATFLWQY

SEQ ID NO: 1035 - protein, 250 aa, Homo sapiens; identical to SEQ ID NO: 1033

SEQ ID NO: 1036 - protein, 213 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATSAEP

SEQ ID NO: 1037 - protein, 233 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATKSNKYNKGLSPLLSSCHLFVAILK

SEQ ID NO: 1038 - protein, 337 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSSF

SEQ ID NO: 1039 - protein, 256 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1040 - protein, 242 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1041 - protein, 260 aa, Homo sapiens
MGPRARPALLLLMLLQTAVLQGRLLQSHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1042 - protein, 76 aa, Homo sapiens
MGPRARPALLLLMLLQTAVLQGRLLQPSPSGTLVIGVISGIAVFVVILFIGILFIILRKRQGSRGAMGHYVLAERE

SEQ ID NO: 1043 - protein, 168 aa, Homo sapiens
MGPRARPALLLLMLLQTAVLQGRLLLPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1044 - protein, 348 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1045 - protein, 325 aa, Homo sapiens
MGPRARPALLLLMLLQTAVLQGRLLPLGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1046 - protein, 334 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1047 - protein, 345 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQEGSESSSLPGKVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1048 - protein, 246 aa, Homo sapiens
MGPRARPALLLLMLLQTAVLQGRLLQSHTLQVILGCEMQEDNSTEGYWKYGYDGQDHLEFCPDTLDWRAAEPRAWPTKLEWERHKIRARQNRAYLERDCPAQLQQLLELGRGVLDQQVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1049 - protein, 161 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQVLQDTIYSSEVSSLGIKF

SEQ ID NO: 1050 - protein, 121 aa, Homo sapiens
MENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVSHPAQPSKES

SEQ ID NO: 1051 - protein, 426 aa, Homo sapiens
MGEPGQSPSPRSSHGSPPTLSTLTLLLLLCGHAHSQCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 1052 - protein, 313 aa, Homo sapiens
MIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 1053 - protein, 93 aa, Homo sapiens
MGEPGQSPSPRSSHGSPPTLSTLTLLLLLCGHAHSQCKILRCNAEYVSSTLSLRGGGSSGALRGGGGGGRGGGVGSGGLCRALRSYALCTRRT

SEQ ID NO: 1054 - protein, 200 aa, Homo sapiens
MQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 1055 - protein, 200 aa, Homo sapiens; identical to SEQ ID NO: 1054

SEQ ID NO: 1056 - protein, 200 aa, Homo sapiens; identical to SEQ ID NO: 1054

SEQ ID NO: 1057 - protein, 200 aa, Homo sapiens; identical to SEQ ID NO: 1054

SEQ ID NO: 1058 - protein, 728 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 1059 - protein, 184 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSGGDDCLVESTFYSIPFWGHNSAR

SEQ ID NO: 1060 - protein, 296 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCGDITWALN

SEQ ID NO: 1061 - protein, 141 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVS

SEQ ID NO: 1062 - protein, 118 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDL

SEQ ID NO: 1063 - protein, 210 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEGK

SEQ ID NO: 1064 - protein, 290 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 1065 - protein, 285 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 1066 - protein, 723 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 1067 - protein, 84 aa, Homo sapiens
MALSSQIWAACLLLLLLLASLTSGSVFPQQTGQLAELQPQDRAGARASWMPMFQRRRRRDTHFPICIFCCGCCHRSKCGMCCKT

SEQ ID NO: 1068 - protein, 84 aa, Homo sapiens; identical to SEQ ID NO: 1067

SEQ ID NO: 1069 - protein, 473 aa, Homo sapiens
MAVMAPRTLVLLLSGALALTQTWAEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1070 - protein, 238 aa, Homo sapiens
MAVMAPRTLVLLLSGALALTQTWADIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1071 - protein, 218 aa, Homo sapiens
MATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 1072 - protein, 218 aa, Homo sapiens
MATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKSRLLAEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 1073 - protein, 550 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 1074 - protein, 343 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGFLMRTNT

SEQ ID NO: 1075 - protein, 312 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQEDQSSTGFRLKTSSTRKYK

SEQ ID NO: 1076 - protein, 179 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGTAPCPESGFSWFVVSESSIPILGMGLSLQSPLLAGRVPR

SEQ ID NO: 1077 - protein, 86 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAP

SEQ ID NO: 1078 - protein, 153 aa, Homo sapiens
MDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 1079 - protein, 339 aa, Homo sapiens
MKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 1080 - protein, 653 aa, Homo sapiens
MRPLRPRAALLALLASLLAAPPVAPAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 1081 - protein, 675 aa, Homo sapiens
MRPLRPRAALLALLASLLAAPPVAPAEAPHLVHVDAARALWPLRRFWRSTGFWGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKVRPAPPSAPVFCALSRCAPGRADPGGAEAAPPAGCAQLHLHPGAGEGRRAADPAALPQVRGHPHLQRRGGPAGGLVPATAVEGGRDLRGHGGEGGPAQRPARPPATFLPRRDRRAVAAPPGPSCPGHPQVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 1082 - protein, 200 aa, Homo sapiens
MALWMRLLPLLALLALWGPDPAAAFVNQHLCGSHLVEALYLVCGERGFFYTPKTRREAEDLQASALSLSSSTSTWPEGLDATARAPPALVVTANIGQAGGSSSRQFRQRALGTSDSPVLFIHCPGAAGTAQGLEYRGRRVTTELVWEEVDSSPQPQGSESLPAQPPAQPAPQPEPQQAREPSPEVSCCGLWPRRPQRSQN

SEQ ID NO: 1083 - protein, 110 aa, Homo sapiens
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 1084 - protein, 110 aa, Homo sapiens; identical to SEQ ID NO: 1083

SEQ ID NO: 1085 - protein, 110 aa, Homo sapiens; identical to SEQ ID NO: 1083

SEQ ID NO: 1086 - protein, 98 aa, Homo sapiens
MALWMRLLPLLALLALWGPDPAAAFVNQHLCGSHLVEALYLVCGERGFFYTPKTRREAEDLQGSLQPLALEGSLQKRGIVEQCCTSICSLYQLENYCN

SEQ ID NO: 1087 - protein, 110 aa, Homo sapiens
MALWMRLLPLLALLALWGPDPAAAFVNQHLCGSHLVEALYLVCGERGFFYTDKTRREAEDLQVGQVELGGGPGAGSLQPLALEGSLQKRGIVEQCCTSICSLYQLENYCN

SEQ ID NO: 1088 - protein, 110 aa, Homo sapiens
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCG

SEQ ID NO: 1089 - protein, 110 aa, Homo sapiens
MALWMRLLPLLALLALWGPDPAAAFVKQHLCGSHLVEALYLVCGERGFFYTPETRREAEDLQVGQVELGGGPGAGSLQPLALEGSLQKRGIVEQCCTSICSLYQLENYCN

SEQ ID NO: 1090 - protein, 110 aa, Homo sapiens
MALWMRLLPLLALLALWGPDPAAAFVNQHLCGSHLVEALYLVCGERGFFYTKPTRREAEDLQVGQVELGGGPGAGSLQPLALEGSLQKRGIVEQCCTSICSLYQLENYCN

SEQ ID NO: 1091 - protein, 189 aa, Homo sapiens
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 1092 - protein, 190 aa, Homo sapiens
MMASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1093 - protein, 189 aa, Homo sapiens
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 1094 - protein, 189 aa, Homo sapiens
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 1095 - protein, 189 aa, Homo sapiens
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1096 - protein, 188 aa, Homo sapiens
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1097 - protein, 189 aa, Homo sapiens
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 1098 - protein, 189 aa, Homo sapiens
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 1099 - protein, 189 aa, Homo sapiens
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 1100 - protein, 189 aa, Homo sapiens
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 1101 - protein, 189 aa, Homo sapiens
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 1102 - protein, 189 aa, Homo sapiens
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1103 - protein, 187 aa, Homo sapiens
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1104 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 1105 - protein, 162 aa, Homo sapiens
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 1106 - protein, 177 aa, Homo sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 1107 - protein, 71 aa, Homo sapiens
MFHVSFRYIFGLPPLILVLLPVASSDCDIEGKDGKQYESVLMVSIDQLLNQPYKKKEKRTERKQQSAMSNN

SEQ ID NO: 1108 - protein, 130 aa, Homo sapiens
VSFRYIFGLPPLILVLLPVASSDCDIEGKDGKQYESVLMVSIDQLLDSMKEIGSNCLNNEFNFFKRHICDANKVKGRKPAALGEAQPTKSLEENKSLKEQKKLNDLCFLKRLLQEIKTCWNKILMGTKEH

SEQ ID NO: 1109 - protein, 71 aa, Homo sapiens; identical to SEQ ID NO: 1107

SEQ ID NO: 1110 - protein, 37 aa, Homo sapiens
MFHVSFRYIFGLPPLILVLLPVASSDCDIEGQHERNW

SEQ ID NO: 1111 - protein, 133 aa, Homo sapiens
MFHVSFRYIFGLPPLILVLLPVASSDCDIEGKDGKQYESVLMVSIDQLLDSMKEIGSNCLNNEFNFFKRHICDANKVKGRKPAALGEAQPTKSLEENKSLKEQKKLNDLCFLKRLLQEIKTCWNKILMGTKEH

SEQ ID NO: 1112 - protein, 37 aa, Homo sapiens; identical to SEQ ID NO: 1110

SEQ ID NO: 1113 - protein, 64 aa, Homo sapiens
MKEIGSNCLNNEFNFFKRHICDANKEENKSLKEQKKLNDLCFLKRLLQEIKTCWNKILMGTKEH

SEQ ID NO: 1114 - protein, 273 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 1115 - protein, 245 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKGKAKNPPGDSSLHWAAMALPALFSLIIGFAFGALYWKKRQPSLTRAVENIQINEEDNEISMLQEKEREFQEV

SEQ ID NO: 1116 - protein, 30 aa, Homo sapiens
GMDVLGRPKIPLETPAYTGQPWHCQHCFLL

SEQ ID NO: 1117 - protein, 1012 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 1118 - protein, 242 aa, Homo sapiens
MTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYH

SEQ ID NO: 1119 - protein, 479 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 1120 - protein, 232 aa, Homo sapiens
MAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSE

SEQ ID NO: 1121 - protein, 22 aa, Homo sapiens
MRQPPGESDMAVSDALLPSFST

SEQ ID NO: 1122 - protein, 38 aa, Homo sapiens
MRQPPGESDMAVSDALLPSFSTFASGPAGREKTLRQAG

SEQ ID NO: 1123 - protein, 440 aa, Homo sapiens
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAGLPAPGVEVYCLYGVGLPTPRTYIYDHGFPYTDPVGVLYEDGDDTVATRSTELCGLWQGRQPQPVHLLPLHGIQHLNMVFSNLTLEHINAILLGAYRQGPPASPTASPEPPPPE

SEQ ID NO: 1124 - protein, 250 aa, Homo sapiens [sequence omitted]

SEQ ID NO: 1125 - protein, 209 aa, Homo sapiens
MGSVSNQQFAGGCAKAAEEAPEEAPEDAARAADEPQLLHGAGICKWFNVRMGFGFLSMTARAGVALDPPVDVFVHQSKLHMEGFRSLKEGEAVEFTFKKSAKGLESIRVTGPGGVFCIGSERRPKGKSMQKRRSKGDRCYNCGGLDHHAKECKLPPQPKKCHFCQSISHMVASCPLKAQQGPSAQGKPTYFREEEEEIHSPTLLPEAQN

SEQ ID NO: 1126 - protein, 209 aa, Homo sapiens; identical to SEQ ID NO: 1125

SEQ ID NO: 1127 - protein, 219 aa, Homo sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRL

SEQ ID NO: 1128 - protein, 399 aa, Homo sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 1129 - protein, 357 aa, Homo sapiens
MKLRTLAVSATVVKDGVSGVCSFRCSDVSGVLPSGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 1130 - protein, 399 aa, Homo sapiens; identical to SEQ ID NO: 1128

SEQ ID NO: 1131 - protein, 343 aa, Homo sapiens
MACLEFVPFDVQMCLEFLPSGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 1132 - protein, 401 aa, Homo sapiens
MACLEFVPFDVQMCLEFLPSGEFVVLLTSGVQLQTFTVSVTDLKGGASGVVRSSRWVRGFTDFRSKAVDLCGPKPVVFLQHGLLADSSNWVTNLANSSLGFILADAGFDVWMGNSRGNTWSRKHKTLSVSQDEFWAFRVPFLDYSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 1133 - protein, 290 aa, Homo sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSV

SEQ ID NO: 1134 - protein, 399 aa, Homo sapiens; identical to SEQ ID NO: 1128

SEQ ID NO: 1135 - protein, 28 aa, Homo sapiens
LCFLLCGFNERNLNMAVKFQKFQAFDWG

SEQ ID NO: 1136 - protein, 399 aa, Homo sapiens; identical to SEQ ID NO: 1128

SEQ ID NO: 1137 - protein, 136 aa, Homo sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHVTLEPGC

SEQ ID NO: 1138 - protein, 475 aa, Homo sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 1139 - protein, 115 aa, Homo sapiens
MVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEY

SEQ ID NO: 1140 - protein, 106 aa, Homo sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDS

SEQ ID NO: 1141 - protein, 130 aa, Homo sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKL

SEQ ID NO: 1142 - protein, 461 aa, Homo sapiens
MESKALLVLTLAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 1143 - protein, 275 aa, Homo sapiens
MVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYEDSFSDALQSLPLPSKDSFFWD

SEQ ID NO: 1144 - protein, 37 aa, Homo sapiens
LLGDFFRKSKEKIGKEFKRIVQRIKDFLRNLVPRTES

SEQ ID NO: 1145 - protein, 692 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCLTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 1146 - protein, 819 aa, Homo sapiens
MGPWGWKLRWTVALLLAAAGTAVGDRCERNEFQCQDGKCISYKWVCDGSAECQDGSDESQETCSPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 1147 - protein, 682 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPREAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 1148 - protein, 858 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSMVSLEDDVA

SEQ ID NO: 1149 - protein, 860 aa, Homo sapiens [sequence omitted]

SEQ ID NO: 1150 - protein, 739 aa, Homo sapiens
MGPWGWKLRWTVALLLAAAGTAVGDRCERNDFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 1151 - protein, 945 aa, Homo sapiens
  MOD_RES (1)..(1): Any amino acid
XGRPGVPPRFLSQRRRQVPGPRSRLRDIHESPSVILGPPGEVPGFRCALWRHLRPHLVLGGALAPPAPIKFTEGPPATLKASVPYEVETLPQNLPAPPWSAAEIFSHVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 1152 - protein, 141 aa, Homo sapiens
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFL

SEQ ID NO: 1153 - protein, 179 aa, Homo sapiens
MGRPGLGAAVSDLGEAVSLSQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQQASSSSKDPPRSLPSPSRLLEPDTPILPQ

SEQ ID NO: 1154 - protein, 97 aa, Homo sapiens
MQLGTGLLLAAVLSLQLAAAEAIWCHQCTGFGGCSHGSRCLRDSTHCVTTATRVLSNTEDLPLVTKMCHIGCPDIPSLGLGPYVSIACCQTSLCNHD

SEQ ID NO: 1155 - protein, 1010 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 1156 - protein, 187 aa, Homo sapiens
  MOD_RES (1)..(1): Any amino acid
XRGGGDSYGVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDN

SEQ ID NO: 1157 - protein, 1011 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 1158 - protein, 950 aa, Homo sapiens
MLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 1159 - protein, 293 aa, Homo sapiens
MGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 1160 - protein, 293 aa, Homo sapiens; identical to SEQ ID NO: 1159

SEQ ID NO: 1161 - protein, 750 aa, Homo sapiens
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGISTLAAGHKTLVPELIKELNSLGRPDILVMCGGVIPPQDYEFLFEVGVSNVFGPGTRIPKAAVQVLDDIEKCLEKKQQSV

SEQ ID NO: 1162 - protein, 197 aa, Homo sapiens
TRYLARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGISTLAAGHKTLVPELIKELNSLGRPDILVMCGGVIPPQDYEFLFEVGVSNVFGPGTRIPKAAVQVLDDIEKCLEKKQQSV

SEQ ID NO: 1163 - protein, 894 aa, Homo sapiens
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRFEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 1164 - protein, 894 aa, Homo sapiens; identical to SEQ ID NO: 1163

SEQ ID NO: 1165 - protein, 178 aa, Homo sapiens
MARAPLRPENTIVRGSANQCQDTYRAEELTGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEV

SEQ ID NO: 1166 - protein, 516 aa, Homo sapiens
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLFHN

SEQ ID NO: 1167 - protein, 1256 aa, Homo sapiens
MLFKLLQRQTYTCLSHRYGLYVCFLGVVVTIVSAFQFGEVVLEWSRDQYHVLFDSYRDNIAGKSFQNRLCLPMPIDVVYTWVNGTDLELLKELQQVREQMEEEQKAMREILGKNTTEPTKKSEKQLECLLTHCIKVPMLVLDPALPANITLKDLPSLYPSFHSASDIFNVAKPKNPSTNVSVVVFDSTKDVEDAHSGLLKGNSRQTVWRGYLTTDKEVPGLVLMQDLAFLSGFPPTFKETNQLKTKLPENLSSKVKLLQLYSEASVALLKLNNPKDFQELNKQTKKNMTIDGKELTISPAYLLWDLSAISQSKQDEDISASRFEDNEELRYSLRSIERHAPWVRNIFIVTNGQIPSWLNLDNPRVTIVTHQDVFRNLSHLPTFSSPAIESHIHRIEGLSQKFIYLNDDVMFGKDVWPDDFYSHSKGQKVYLTWPVPNCAEGCPGSWIKDGYCDKACNNSACDWDGGDCSGNSGGSRYIAGGGGTGSIGVGQPWQFGGGINSVSYCNQGCANSWLADKFCDQACNVLSCGFDAGDCGQDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 1168 - protein, 490 aa, Homo sapiens
MLFKLLQRQTYTCLSHRYGLYVCFLGVVVTIVSAFQFGEVVLEWSRDQYHVLFDSYRDNIAGKSFQNRLCLPMPIDVVYTWVNGTDLELLKELQQVREQMEEEQKAMREILGKNTTEPTKKSEKQLECLLTHCIKVPMLVLDPALPANITLKDLPSLYPSFHSASDIFNVAKPKNPSTNVSVVVFDSTKDVEDAHSGLLKGNSRQTVWRGYLTTDKEVPGLVLMQDLAFLSGFPPTFKETNQLKTKLPENLSSKVKLLQLYSEASVALLKLNNPKDFQELNKQTKKNMTIDGKELTISPAYLLWDLSAISQSKQDEDISASRFEDNEELRYSLRSIERHAPWVRNIFIVTNGQIPSWLNLDNPRVTIVTHQDVFRNLSHLPTFSSPAIESHIHRIEGLSQKFIYLNDDVMFGKDVWPDDFYSHSKGQKVYLTWPVPNCAEGCPGSWIKDGYCDKACNNSACDWDGGDCSGKDVLNCNSFIFMEYFLLNHY

SEQ ID NO: 1169 - protein, 534 aa, Homo sapiens
MATALMAVVLRAAAVAPRLRGRGGTGGARRLSCGARRRAARGTSPGRRLSTAWSQPQPPPEEYAGADDVSQSPVAEEPSWVPSPRPPVPHESPEPPSGRSLVQRDIQAFLNQCGASPGEARHWLTQFQTCHHSADKPFAVIEVDEEVLKCQQGVSSLAFALAFLQRMDMKPLVVLGLPAPTAPSGCLSFWEAKAQLAKSCKVLVDALRHNAAAAVPFFGGGSVLRAAEPAPHASYGGIVSVETDLLQWCLESGSIPILCPIGETAARRSVLLDSLEVTASLAKALRPTKIIFLNNTGGLRDSSHKVLSNVNLPADLDLVCNAEWVSTKERQQMRLIVDVLSRLPHHSSAVITAASTLLTELFSNKGSGTLFKNAERMLRVRSLDKLDQGRLVDLVNASFGKKLRDDYLASLRPRLHSIYVSEGYNAAAILTMEPVLGGTPYLDKFVVSSSRQGQGSGQMLWECLRRDLQTLFWRSRVTNPINPWYFKHSDGSFSNKQWIFFWFGLADIRDSYELVNHAKGLPDSFHKPASDPGS

SEQ ID NO: 1170 - protein, 368 aa, Homo sapiens
MDMKPLVVLGLPAPTAPSGCLSFWEAKAQLAKSCKVLVDALRHNAAAAVPFFGGGSVLRAAEPAPHASYGGIVSVETDLLQWCLESGSIPILCPIGETAARRSVLLDSLEVTASLAKALRPTKIIFLNNTGGLRDSSHKVLSNVNLPADLDLVCNAEWVSTKERQQMRLIVDVLSRLPHHSSAVITAASTLLTELFSNKGSGTLFKNAERMLRVRSLDKLDQGRLVDLVNASFGKKLRDDYLASLRPRLHSIYVSEGYNAAAILTMEPVLGGTPYLDKFVVSSSRQGQGSGQMLWECLRRDLQTLFWRSRVTNPINPWYFKHSDGSFSNKQWIFFWFGLADIRDSYELVNHAKGLPDSFHKPASDPGS

SEQ ID NO: 1171 - protein, 395 aa, Homo sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1172 - protein, 389 aa, Homo sapiens
MNCCIGLGEKARGSHRASYPSLSALFTEASILGFGSFAVKAQWTEDCRKSTYPPSGPTVFPAVIRYRGAVPWYTINLDLPPYKRWHELMLDKAPVPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1173 - protein, 411 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1174 - protein, 305 aa, Homo sapiens
MLDKAPVLKVIVNSLKNMINTFVPSGKIMQVVDEKLPGLLGNFPGPFEEEMKGIAAVTDIPLGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1175 - protein, 370 aa, Homo sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1176 - protein, 134 aa, Homo sapiens
MDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSPKMVQGSGCFGRKMDRISSSSGLGCKVLRRH

SEQ ID NO: 1177 - protein, 241 aa, Homo sapiens
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 1178 - protein, 640 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1179 - protein, 637 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1180 - protein, 611 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1181 - protein, 648 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHSGEPFPEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1182 - protein, 247 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESAQMSLLVIAAKTT

SEQ ID NO: 1183 - protein, 645 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1184 - protein, 640 aa, Homo sapiens; identical to SEQ ID NO: 1178

SEQ ID NO: 1185 - protein, 590 aa, Homo sapiens
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1186 - protein, 422 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 1187 - protein, 296 aa, Homo sapiens
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYSTSTPFLSLPE

SEQ ID NO: 1188 - protein, 462 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 1189 - protein, 483 aa, Homo sapiens
MQIPKHISIEDITATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1190 - protein, 420 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSER

SEQ ID NO: 1191 - protein, 439 aa, Homo sapiens
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAETQKLISEIDLLRKQNEQLKHKLEQLRNSCA

SEQ ID NO: 1192 - protein, 354 aa, Homo sapiens
MLFNLRILLNNAAFRNGHNFMVRNFRCGQPLQNKVQLKGRDLLTLKNFTGEEIKYMLWLSADLKFRIKQKGEYLPLLQGKSLGMIFEKRSTRTRLSTETGFALLGGHPCFLTTQDIHLGVNESLTDTARVLSSMADAVLARVYKQSDLDTLAKEASIPIINGLSDLYHPIQILADYLTLQEHYSSLKGLTLSWIGDGNNILHSIMMSAAKFGMHLQAATPKGYEPDASVTKLAEQYAKENGTKLLLTNDPLEAAHGGNVLITDTWISMGQEEEKKKRLQAFQGYQVTMKTAKVAASDWTFLHCLPRKPEEVDDEVFYSPRSLVFPEAENRKWTIMAVMVSLLTDYSPQLQKPKF

SEQ ID NO: 1193 - protein, 115 aa, Homo sapiens
MIPAKDMAKVMIVMLAICFLTKSDGKSVKKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 1194 - protein, 115 aa, Homo sapiens; identical to SEQ ID NO: 1193

SEQ ID NO: 1195 - protein, 117 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDT

SEQ ID NO: 1196 - protein, 136 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQIL

SEQ ID NO: 1197 - protein, 452 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 1198 - protein, 1086 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 1199 - protein, 406 aa, Homo sapiens
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 1200 - protein, 1235 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 1201 - protein, 1086 aa, Homo sapiens; identical to SEQ ID NO: 1198

SEQ ID NO: 1202 - protein, 1093 aa, Homo sapiens
MAGAAGLTAEVSWKVLERRARTKRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWLAVRYGAAFTQKFSSSIAPHITTFLVHGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 1203 - protein, 1086 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWLAVRYGAAFTQKFSSSIAPHITTFLVHGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 1204 - protein, 406 aa, Homo sapiens; identical to SEQ ID NO: 1199

SEQ ID NO: 1205 - protein, 374 aa, Homo sapiens
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWIRKQWIGKLMACV

SEQ ID NO: 1206 - protein, 847 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 1207 - protein, 813 aa, Homo sapiens
MAKPLTDQEKRRQISIRGIVGVENVAELKKSFNRHLHFTLVKDRNVATTRDYYFALAHTVRDHLVGRWIRTQQHYYDKCPKLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 1208 - protein, 810 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1209 - protein, 210 aa, Homo sapiens
RFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1210 - protein, 136 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPR

SEQ ID NO: 1211 - protein, 562 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 1212 - protein, 293 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRCRTGRSVSSPATASMRPCLLSIRSG

SEQ ID NO: 1213 - protein, 516 aa, Homo sapiens
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 1214 - protein, 562 aa, Homo sapiens; identical to SEQ ID NO: 1211

SEQ ID NO: 1215 - protein, 436 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKRNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 1216 - protein, 499 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 1217 - protein, 178 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNY

SEQ ID NO: 1218 - protein, 157 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALA

SEQ ID NO: 1219 - protein, 473 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 1220 - protein, 360 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 1221 - protein, 265 aa, Homo sapiens
MHFYRLFLGATRRFLNPEWKGEIDNWCVYVLTSLLPFKIQSQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 1222 - protein, 360 aa, Homo sapiens; identical to SEQ ID NO: 1220

SEQ ID NO: 1223 - protein, 265 aa, Homo sapiens; identical to SEQ ID NO: 1221

SEQ ID NO: 1224 - protein, 265 aa, Homo sapiens; identical to SEQ ID NO: 1221

SEQ ID NO: 1225 - protein, 360 aa, Homo sapiens; identical to SEQ ID NO: 1220

SEQ ID NO: 1226 - protein, 360 aa, Homo sapiens; identical to SEQ ID NO: 1220

SEQ ID NO: 1227 - protein, 265 aa, Homo sapiens; identical to SEQ ID NO: 1221

SEQ ID NO: 1228 - protein, 360 aa, Homo sapiens; identical to SEQ ID NO: 1220

SEQ ID NO: 1229 - protein, 122 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGGGEQLRWGLPGALHRHPWCREA

SEQ ID NO: 1230 - protein, 265 aa, Homo sapiens; identical to SEQ ID NO: 1221

SEQ ID NO: 1231 - protein, 360 aa, Homo sapiens; identical to SEQ ID NO: 1220

SEQ ID NO: 1232 - protein, 123 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVETPMGPPRSPAPHPFPFPLL

SEQ ID NO: 1233 - protein, 185 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVHPGGSIWEGIQPNDHLPL

SEQ ID NO: 1234 - protein, 123 aa, Homo sapiens; identical to SEQ ID NO: 1232

SEQ ID NO: 1235 - protein, 185 aa, Homo sapiens; identical to SEQ ID NO: 1233

SEQ ID NO: 1236 - protein, 123 aa, Homo sapiens; identical to SEQ ID NO: 1232

SEQ ID NO: 1237 - protein, 185 aa, Homo sapiens; identical to SEQ ID NO: 1233

SEQ ID NO: 1238 - protein, 185 aa, Homo sapiens; identical to SEQ ID NO: 1233

SEQ ID NO: 1239 - protein, 123 aa, Homo sapiens; identical to SEQ ID NO: 1232

SEQ ID NO: 1240 - protein, 123 aa, Homo sapiens; identical to SEQ ID NO: 1232

SEQ ID NO: 1241 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 1242 - protein, 205 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPAYLEDHCGGHRGAVQMALQKTQETLGQEQFD

SEQ ID NO: 1243 - protein, 266 aa, Homo sapiens
MVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVGSCFAGLYGQHTRGLHGWPQPSPAAPQMRSC

SEQ ID NO: 1244 - protein, 461 aa, Homo sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 1245 - protein, 495 aa, Homo sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQRGEGERWMLAGGGAGLGPGWGRGTSTSCPRPPLPAEVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 1246 - protein, 461 aa, Homo sapiens; identical to SEQ ID NO: 1244

SEQ ID NO: 1247 - protein, 116 aa, Homo sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIG

SEQ ID NO: 1248 - protein, 126 aa, Homo sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGW

SEQ ID NO: 1249 - protein, 516 aa, Homo sapiens
MAAGRRTCSISTTRPCASASRMWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQRGEGERWMLAGGGAGLGPGWGRGTSTSCPRPPLPAEVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 1250 - protein, 420 aa, Homo sapiens
MWMTHWPSGPSTSTVTSAWSCPWSTRAPACAAGTARASTASAASAATAAAAGRAASASAVRGRGGCWRGGAGLGPGWGRGTSTSCPRPPLPAEVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 1251 - protein, 117 aa, Homo sapiens
MPRLFFFHLLGVCLLLNQFSRAVADSWMEEVIKLCGRELVRAQIAICGMSTWSKRSLSQEDAPQTPRPVAGDFIQTVSLGISPDGGKALRTGSCFTREFLGALSKLCHPSSTKIQKP

SEQ ID NO: 1252 - protein, 185 aa, Homo sapiens
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 1253 - protein, 348 aa, Homo sapiens [sequence omitted]

SEQ ID NO: 1254 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 1255 - protein, 418 aa, Homo sapiens; identical to SEQ ID NO: 1254

SEQ ID NO: 1256 - protein, 418 aa, Homo sapiens; identical to SEQ ID NO: 1254

SEQ ID NO: 1257 - protein, 359 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKVRSP

SEQ ID NO: 1258 - protein, 418 aa, Homo sapiens; identical to SEQ ID NO: 1254

SEQ ID NO: 1259 - protein, 418 aa, Homo sapiens; identical to SEQ ID NO: 1254

SEQ ID NO: 1260 - protein, 418 aa, Homo sapiens; identical to SEQ ID NO: 1254

SEQ ID NO: 1261 - protein, 418 aa, Homo sapiens; identical to SEQ ID NO: 1254

SEQ ID NO: 1262 - protein, 418 aa, Homo sapiens; identical to SEQ ID NO: 1254

SEQ ID NO: 1263 - protein, 92 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGT

SEQ ID NO: 1264 - protein, 156 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLE

SEQ ID NO: 1265 - protein, 117 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIH

SEQ ID NO: 1266 - protein, 22 aa, Homo sapiens
MPSSVSWGILLLAGLCCLVPVS

SEQ ID NO: 1267 - protein, 144 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFL

SEQ ID NO: 1268 - protein, 259 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNDLYVSDAFHKAFLEVNEEGSEAAASTAVVIAGRSLNPNRVTFKANRPFLVFIREVPLNTIIFMGRVANPCVK

SEQ ID NO: 1269 - protein, 464 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 1270 - protein, 491 aa, Homo sapiens
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 1271 - protein, 491 aa, Homo sapiens; identical to SEQ ID NO: 1270

SEQ ID NO: 1272 - protein, 427 aa, Homo sapiens
MALLWGLLVLSWSCLQGPCSVFSPVSAMEPLGRQLTSGPNQEQVSPLTLLKLGNQVQPGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 1273 - protein, 255 aa, Homo sapiens
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSF

SEQ ID NO: 1274 - protein, 500 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 1275 - protein, 505 aa, Homo sapiens
MASRLTLLTLLLLLLAGFLEPQDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 1276 - protein, 448 aa, Homo sapiens
MLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 1277 - protein, 160 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAM

SEQ ID NO: 1278 - protein, 133 aa, Homo sapiens [sequence omitted]

SEQ ID NO: 1279 - protein, 747 aa, Homo sapiens
MADEAALALQPGGSPSAAGADREAASSPAGEPLRKRPRRDGPGLERSPGEPGGAAPEREVPAAARGCPGAAAAALWREAEAEAAAAGGEQEAQATAAAGEGDNGPGLQGPSREPPLADNLYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 1280 - protein, 444 aa, Homo sapiens
MCLCSGRKTILEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 1281 - protein, 444 aa, Homo sapiens; identical to SEQ ID NO: 1280

SEQ ID NO: 1282 - protein, 452 aa, Homo sapiens
MFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 1283 - protein, 328 aa, Homo sapiens
MSVNYAAGLSPYADKGKCGLPEIFDPPEELERKVWELARLVWQSSSVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 1284 - protein, 355 aa, Homo sapiens
MSVNYAAGLSPYADKGKCGLPEIFDPPEELERKVWELARLVWQSSSVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 1285 - protein, 283 aa, Homo sapiens
MEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 1286 - protein, 524 aa, Homo sapiens
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 1287 - protein, 405 aa, Homo sapiens
MHLNRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 1288 - protein, 429 aa, Homo sapiens
MAAQGYGYYRTVIFSAMFGGYSLYYFNRKTFSFVMPSLVEEIPLDKDDLGFITSSQSAAYAISKFVSGVLSDQMSARWLFSSGLLLVGLVNIFFAWSSTVPVFAALWFLNGLAQGLGWPPCGKVLRKWFEPSQFGTWWAILSTSMNLAGGLGPILATILAQSYSWRSTLALSGALCVVVSFLCLLLIHNEPADVGLRNLDPMPSEGKKGSLKEESTLQELLLSPYLWVLSTGYLVVFGVKTCCTDWGQFFLIQEKGQSALVGSSYMSALEVGGLVGSIAAGYLSDRAMAKAGLSNYGNPRHGLLLFMMAGMTVSMYLFRVTVTSDSPKLWILVLGAVFGFSSYGPIALFGVIANESAPPNLCGTSHAIVGLMANVGGFLAGLPFSTIAKHYSWSTAFWVAEVICAASTAAFFLLRNIRTKMGRVSKKAE

SEQ ID NO: 1289 - protein, 451 aa, Homo sapiens
MAAQGYGYYRTVIFSAMFGGYSLYYFNRKTFSFVMPSLVEEIPLDKDDLGFITSSQSAAYAISKFVSGVLSDQMSARWLFSSGLLLVGLVNIFFAWSSTVPVFAALWFLNGLAQGLGWPPCGKVLRKWFEPSQFGTWWAILSTSMNLAGGLGPILATILAQSYSWRSTLALSGALCVVVSFLCLLLIHNEPADVGLRNLDPMPSEGKKGSLKEESTLQELLLSPYLWVLSTGYLVVFGVKTCCTDWGQFFLIQEKGQSALVGSSYMSALEVGGLVGSIAAGYLSDRAMAKAGLSNYGNPRHGLLLFMMAGMTVSMYLFRVTVTSDSPKDVAFWTLALHPLAELTGFTEHELWILVLGAVFGFSSYGPIALFGVIANESAPPNLCGTSHAIVGLMANVGGFLAGLPFSTIAKHYSWSTAFWVAEVICAASTAAFFLLRNIRTKMGRVSKKAE

SEQ ID NO: 1290 - protein, 571 aa, Homo sapiens
MTRAGDHNRQRGCCGSLADYLTSAKFLLYLGHSLSTWGDRMWHFAVSVFLVELYGNSLLLTAVYGLVVAGSVLVLGAIIGDWVDKNARLKVAQTSLVVQNVSVILCGIILMMVFLHKHELLTMYHGWVLTSCYILIITIANIANLASTATAITIQRDWIVVVAGEDRSKLANMNATIRRIDQLTNILAPMAVGQIMTFGSPVIGCGFISGWNLVSMCVEYVLLWKVYQKTPALAVKAGLKEEETELKQLNLHKDTEPKPLEGTHLMGVKDSNIHELEHEQEPTCASQMAEPFRTFRDGWVSYYNQPVFLAGMGLAFLYMTVLGFDCITTGYAYTQGLSGSILSILMGASAITGIMGTVAFTWLRRKCGLVRTGLISGLAQLSCLILCVISVFMPGSPLDLSVSPFEDIRSRFIQGESITPTKIPEITTEIYMSNGSNSANIVPETSPESVPIISVSLLFAGVIAARIGLWSFDLTVTQLLQENVIESERGIINGVQNSMNYLLDLLHFIMVILAPNPEAFGLLVLISVSFVAMGHIMYFRFAQNTLGNKLFACGPDAKEVRKENQANTSVV

SEQ ID NO: 1291 - protein, 200 aa, Homo sapiens
MTRAGDHNRQRGCCGSLADYLTSAKFLLYLGHSLSTWGDRMWHFAVSVFLVELYGNSLLLTAVYGLVVAGSVLVLGAIIGDWVDKNARLKVAQTSLVVQNVSVILCGIILMMVFLHKHELLTMYHGWVLTSCYILIITIANIANLASTATAITIQRDWIVVVAGEDRSKLANMNATIRRIDQLTNILAPMAVGQIMTFGS

SEQ ID NO: 1292 - protein, 25 aa, Homo sapiens
MTRAGDHNRQRGCCGSLADYLTSAK

SEQ ID NO: 1293 - protein, 25 aa, Homo sapiens
MTRAGDHNRQRGCCGSLADYLTSAK

SEQ ID NO: 1294 - protein, 55 aa, Homo sapiens
MTRAGDHNRQRGCCGSLADYLTSAKFLLYLGHSLSTWGDRMWHFAVSVFLVELYG

SEQ ID NO: 1295 - protein, 99 aa, Homo sapiens
MRASIHKKLRKSSGIVTILYSAFVLVSTSDMAEETEDAWPRCYLQFLALLLTSTSARAAAAIAAAEEPAGSPSVMTRAGDHNRQRGCCGSLADYLTSAK

SEQ ID NO: 1296 - protein, 167 aa, Homo sapiens [sequence omitted]

SEQ ID NO: 1297 - protein, 831 aa, Homo sapiens
MERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 1298 - protein, 694 aa, Homo sapiens
MTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCTDLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 1299 - protein, 509 aa, Homo sapiens
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 1300 - protein, 511 aa, Homo sapiens
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIWRLEVWDQGISRIGFF

SEQ ID NO: 1301 - protein, 509 aa, Homo sapiens; identical to SEQ ID NO: 1299

SEQ ID NO: 1302 - protein, 80 aa, Homo sapiens
MGVLKFKHIFFRSFVKSSGVSQIVFTFLLIPCCLTLNFRAPPVIPNVPFLWAWNAPSEFCLGKFDEPLDMSLFSFIGSPR

SEQ ID NO: 1303 - protein, 509 aa, Homo sapiens; identical to SEQ ID NO: 1299

SEQ ID NO: 1304 - protein, 509 aa, Homo sapiens; identical to SEQ ID NO: 1299

SEQ ID NO: 1305 - protein, 587 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRYLSSVETQEGKRKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 1306 - protein, 631 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 1307 - protein, 575 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 1308 - protein, 630 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 1309 - protein, 366 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRCI

SEQ ID NO: 1310 - protein, 402 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRYLSSVETQEGKRKNWGVLCSFPIPRSPPHLSQYEFLFP

SEQ ID NO: 1311 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 1312 - protein, 317 aa, Homo sapiens; identical to SEQ ID NO: 1311

SEQ ID NO: 1313 - protein, 393 aa, Homo sapiens
MHQAGYPGCRGAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 1314 - protein, 393 aa, Homo sapiens; identical to SEQ ID NO: 1313

SEQ ID NO: 1315 - protein, 349 aa, Homo sapiens
MAESHLLQWLLLLLPTLCGPGTAAWTTSSLACAQGPEFWCQSLEQALQCRALGHCLQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 1316 - protein, 383 aa, Homo sapiens
GAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 1317 - protein, 575 aa, Homo sapiens
MLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 1318 - protein, 557 aa, Homo sapiens
MSEAASQGLRAAARSVWAGTDRRGCRHRRPVPLCSGTALSQCPRFPRRLHAARLGNMLGVLVLGALALAGLGFPAPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 1319 - protein, 353 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 1320 - protein, 314 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 1321 - protein, 286 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKDFWIVGDKLHCLSQNYWLWASEVAAGIQSQDSWSAEPNLQVPGPNPRIPEQDTRTLEWNSWTLSWTLTQDPRSPGHFLRNIRHRLPATQPPAWIFSFPNPSSYWTVYALPSSTHLAHPCGPAPPPAS

SEQ ID NO: 1322 - protein, 349 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 1323 - protein, 801 aa, Homo sapiens
MERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPAQPISADIASRLLRKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 1324 - protein, 355 aa, Homo sapiens
MERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKEAQRPCGPPRMAGEPPRLPLSPGPRATTAASGQQSQDLHPHQQHLRLHRRPLRARSLRCHRGPEGCMGPRSS

SEQ ID NO: 1325 - protein, 801 aa, Homo sapiens; identical to SEQ ID NO: 1323

SEQ ID NO: 1326 - protein, 342 aa, Homo sapiens
MVSNGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 1327 - protein, 390 aa, Homo sapiens
MPPSGLRLLPLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 1328 - protein, 442 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 1329 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 1330 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 1331 - protein, 309 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFR

SEQ ID NO: 1332 - protein, 147 aa, Homo sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYTIAALLSPYSYSTTAVVTNPKE

SEQ ID NO: 1333 - protein, 184 aa, Homo sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVSIQTFEAFQEILYKKKFTTLWHWTSGGQSFFRALVEVVFTANDSGPRRYTIAALLSPYSYSTTAVVTNPKE

SEQ ID NO: 1334 - protein, 139 aa, Homo sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYYSYSTTAVVTNPKE

SEQ ID NO: 1335 - protein, 331 aa, Homo sapiens
MNGTRNWCTLVDVHPEDQAAVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 1336 - protein, 365 aa, Homo sapiens
MNGTRNWCTLVDVHPEDQAAAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 1337 - protein, 390 aa, Homo sapiens
MNGTRNWCTLVDVHPEDQAAGSVDILRLTLQGELTGDELEHIAQKAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 1338 - protein, 199 aa, Homo sapiens [sequence omitted]

SEQ ID NO: 1339 - protein, 409 aa, Homo sapiens
MSSPGMTSLQLEKEECMQCVPCSPRTRVALLELYRAMCQGSVDILRLTLQGELTGDELEHIAQKAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 1340 - protein, 180 aa, Homo sapiens
MNGTRNWCTLVDVHPEDQAAAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALKAGDTDVQSDWRMSWGNEVPSTNTAQFLATNCLFFYLLHLQPTLPWPPADR

SEQ ID NO: 1341 - protein, 393 aa, Homo sapiens [sequence omitted]

SEQ ID NO: 1342 - protein, 343 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQKTFPARHGGSHL

SEQ ID NO: 1343 - protein, 382 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 1344 - protein, 285 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSRPRQVDHLRSGVQDSLANIAKSHLY

SEQ ID NO: 1345 - protein, 90 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVSGRRG

SEQ ID NO: 1346 - protein, 44 aa, Homo sapiens
PLPSQRRNHWMENISPFSHLKSKKGQSTSRHKKLMFKTEGPDSD

SEQ ID NO: 1347 - protein, 341 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 1348 - protein, 393 aa, Homo sapiens [sequence omitted]

SEQ ID NO: 1349 - protein, 346 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 1350 - protein, 128 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSP

SEQ ID NO: 1351 - protein, 165 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQ

SEQ ID NO: 1352 - protein, 199 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQ

SEQ ID NO: 1353 - protein, 155 aa, Homo sapiens
MEEPQSDPSVEPPLSQETFSDLWKLLPENNVLYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNR

SEQ ID NO: 1354 - protein, 155 aa, Homo sapiens; identical to SEQ ID NO: 1353

SEQ ID NO: 1355 - protein, 529 aa, Homo sapiens [sequence omitted]

SEQ ID NO: 1356 - protein, 454 aa, Homo sapiens [sequence omitted]

SEQ ID NO: 1357 - protein, 533 aa, Homo sapiens
MAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 1358 - protein, 444 aa, Homo sapiens
MAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRKKQQSGRQM

SEQ ID NO: 1359 - protein, 530 aa, Homo sapiens
MARAGWTSPVPLCVCLLLTCGFAEAGKLLVVPMDGSHWFTMQSVVEKLILRGHEVVVVMPEVSWQLERSLNCTVKTYSTSYTLEDQNREFMVFAHAQWKAQAQSIFSLLMSSSSGFLDLFFSHCRSLFNDRKLVEYLKESSFDAVFLDPFDTCGLIVAKYFSLPSVVFTRGIFCHHLEEGAQCPAPLSYVPNDLLGFSDAMTFKERVWNHIVHLEDHLFCQYLFRNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 1360 - protein, 534 aa, Homo sapiens
MATGLQVPLPWLATGLLLLLSVQPWAESGKVLVVPIDGSHWLSMREVLRELHARGHQAVVLTPEVNMHIKEENFFTLTTYAISWTQDEFDRHVLGHTQLYFETEHFLKKFFRSMAMLNNMSLVYHRSCVELLHNEALIRHLNATSFDVVLTDPVNLCAAVLAKYLSIPTVFFLRNIPCDLDFKGTQCPNPSSYIPRLLTTNSDHMTFMQRVKNMLYPLALSYICHAFSAPYASLASELFQREVSVVDILSHASVWLFRGDFVMDYPRPIMPNMVFIGGINCANRKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 1361 - protein, 489 aa, Homo sapiens
MAGQRVLLLVGFLLPGVLLSEAAKILTISTVDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFGDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 1362 - protein, 523 aa, Homo sapiens
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFGDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 1363 - protein, 138 aa, Homo sapiens
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRGKFENLLNVLEYLALQCSHFLNRKDIMDSLKNEN

SEQ ID NO: 1364 - protein, 221 aa, Homo sapiens
MVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 1365 - protein, 163 aa, Homo sapiens
MAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 1366 - protein, 317 aa, Homo sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 1367 - protein, 412 aa, Homo sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 1368 - protein, 327 aa, Homo sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 1369 - protein, 371 aa, Homo sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 1370 - protein, 147 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 1371 - protein, 389 aa, Homo sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 1372 - protein, 354 aa, Homo sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 1373 - protein, 395 aa, Homo sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 1374 - protein, 137 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 1375 - protein, 371 aa, Homo sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 1376 - protein, 209 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 1377 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 1378 - protein, 323 aa, Homo sapiens
  MOD_RES (1)..(1): Any amino acid
XRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVCDKPRR

SEQ ID NO: 1379 - protein, 215 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 1380 - protein, 174 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 1381 - protein, 232 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 1382 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 1383 - protein, 420 aa, Homo sapiens
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMMS

SEQ ID NO: 1384 - protein, 169 aa, Homo sapiens
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSNISEDPVPVKRHSDAVFTDNYTRLRKQMAVKKYLNSILNGKRSSEGESPDFPEELEK

SEQ ID NO: 1385 - protein, 170 aa, Homo sapiens
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSSEGESPDFPEELEK

SEQ ID NO: 1386 - protein, 119 aa, Homo sapiens
  MOD_RES (1)..(1): Any amino acid
XVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSEGESPDFPEELEK

SEQ ID NO: 1387 - protein, 257 aa, Homo sapiens
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSGGTRR

SEQ ID NO: 1388 - protein, 454 aa, Homo sapiens
LDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 1389 - protein, 420 aa, Homo sapiens
MPLNVSFTNRNYDLDYDSVQPYFYCDEEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 1390 - protein, 453 aa, Homo sapiens
LDFFRVVENQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 1391 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCQDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 1392 - protein, 271 aa, Homo sapiens
MTEPQVGCVACPRVHKEPAQVGTPWPAKPRSHPRKRDPTALLPRSLWPACQESVTALCFLQETVERLGQSPAQDTPVLGPCWDPMALGTQGRLLLDRDSKDTQTRISQKGRRLQPPGTPSAPPQRRPRKQLNPCRGTERVDPGFEGVTLKFQIKPDSSLQIIPTYSLPCSSRSQESPADAVGGPAAHPGGTEAHSAGSEALEPRRCASCRTQRTPLWRDAEDGTPLCNACGIRYKKYGTRCSSCWLVPRKNVQPKRLCGRCGVSLDPIQEG

SEQ ID NO: 1393 - DNA, 4113 bp, Artificial Sequence
  Description of Artificial Sequence: Synthetic coding sequence
atgcaccagcgccacccccgcgcccgctgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggccgcccccccagccccggcttccagcgccagcgccagcgccagcgccgcgccgccggcggcatcctgcacctggagctgctggtggccgtgggccccgacgtgttccaggcccaccaggaggacaccgagcgctacgtgctgaccaacctgaacatcggcgccgagctgctgcgcgaccccagcctgggcgcccagttccgcgtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcacccgcttcgacctggagctgcccgacggcaaccgccaggtgcgcggcgtgacccagctgggcggcgcctgcagccccacctggagctgcctgatcaccgaggacaccggcttcgacctgggcgtgaccatcgcccacgagatcggccacagcttcggcctggagcacgacggcgcccccggcagcggctgcggccccagcggccacgtgatggccagcgacggcgccgccccccgcgccggcctggcctggagcccctgcagccgccgccagctgctgagcctgctgagcgccggccgcgcccgctgcgtgtgggaccccccccgcccccagcccggcagcgccggccacccccccgacgcccagcccggcctgtactacagcgccaacgagcagtgccgcgtggccttcggccccaaggccgtggcctgcaccttcgcccgcgagcacctggacatgtgccaggccctgagctgccacaccgaccccctggaccagagcagctgcagccgcctgctggtgcccctgctggacggcaccgagtgcggcgtggagaagtggtgcagcaagggccgctgccgcagcctggtggagctgacccccatcgccgccgtgcacggccgctggagcagctggggcccccgcagcccctgcagccgcagctgcggcggcggcgtggtgacccgccgccgccagtgcaacaacccccgccccgccttcggcggccgcgcctgcgtgggcgccgacctgcaggccgagatgtgcaacacccaggcctgcgagaagacccagctggagttcatgagccagcagtgcgcccgcaccgacggccagcccctgcgcagcagccccggcggcgccagcttctaccactggggcgccgccgtgccccacagccagggcgacgccctgtgccgccacatgtgccgcgccatcggcgagagcttcatcatgaagcgcggcgacagcttcctggacggcacccgctgcatgcccagcggcccccgcgaggacggcaccctgagcctgtgcgtgagcggcagctgccgcaccttcggctgcgacggccgcatggacagccagcaggtgtgggaccgctgccaggtgtgcggcggcgacaacagcacctgcagcccccgcaagggcagcttcaccgccggccgcgcccgcgagtacgtgaccttcctgaccgtgacccccaacctgaccagcgtgtacatcgccaaccaccgccccctgttcacccacctggccgtgcgcatcggcggccgctacgtggtggccggcaagatgagcatcagccccaacaccacctaccccagcctgctggaggacggccgcgtggagtaccgcgtggccctgaccgaggaccgcctgccccgcctggaggagatccgcatctggggccccctgcaggaggacgccgacatccaggtgtaccgccgctacggcgaggagtacggcaacctgacccgccccgacatcaccttcacctacttccagcccaagccccgccaggcctgggtgtgggccgccgtgcgcggcccctgcagcgtgagctgcggcgccggcctgcgctgggtgaactacagctgcctggaccaggcccgcaaggagctggtggagaccgtgcagtgccagggcagccagcagccccccgcctggcccgaggcctgcgtgctggagccctgccccccctactgggccgtgggcgacttcggcccctgcagcgccagctgcggcggcggcctgcgcgagcgccccgtgcgctgcgtggaggcccagggcagcctgctgaagaccctgccccccgcccgctgccgcgccggcgcccagcagcccgccgtggccctggagacctgcaacccccagccctgccccgcccgctgggaggtgagcgagcccagcagctgcaccagcgccggcggcgccggcctggccctggagaacgagacctgcgtgcccggcgccgacggcctggaggcccccgtgaccgagggccccggcagcgtggacgagaagctgcccgcccccgagccctgcgtgggcatgagctgcccccccggctggggccacctggacgccaccagcgccggcgagaaggcccccagcccctggggcagcatccgcaccggcgcccaggccgcccacgtgtggacccccgccgccggcagctgcagcgtgagctgcggccgcggcctgatggagctgcgcttcctgtgcatggacagcgccctgcgcgtgcccgtgcaggaggagctgtgcggcctggccagcaagcccggcagccgccgcgaggtgtgccaggccgtgccctgccccgcccgctggcagtacaagctggccgcctgcagcgtgagctgcggccgcggcgtggtgcgccgcatcctgtactgcgcccgcgcccacggcgaggacgacggcgaggagatcctgctggacacccagtgccagggcctgccccgccccgagccccaggaggcctgcagcctggagccctgccccccccgctggaaggtgatgagcctgggcccctgcagcgccagctgcggcctgggcaccgcccgccgcagcgtggcctgcgtgcagctggaccagggccaggacgtggaggtggacgaggccgcctgcgccgccctggtgcgccccgaggccagcgtgccctgcctgatcgccgactgcacctaccgctggcacgtgggcacctggatggagtgcagcgtgagctgcggcgacggcatccagcgccgccgcgacacctgcctgggcccccaggcccaggcccccgtgcccgccgacttctgccagcacctgcccaagcccgtgaccgtgcgcggctgctgggccggcccctgcgtgggccagggcgcctgcggccgccagcacctggagcccaccggcaccatcgacatgcgcggccccggccaggccgactgcgccgtggccatcggccgccccctgggcgaggtggtgaccctgcgcgtgctggagagcagcctgaactgcagcgccggcgacatgctgctgctgtggggccgcctgacctggcgcaagatgtgccgcaagctgctggacatgaccttcagcagcaagaccaacaccctggtggtgcgccagcgctgcggccgccccggcggcggcgtgctgctgcgctacggcagccagctggcccccgagaccttctaccgcgagtgcgacatgcagctgttcggcccctggggcgagatcgtgagccccagcctgagccccgccaccagcaacgccggcggctgccgcctgttcatcaacgtggccccccacgcccgcatcgccatccacgccctggccaccaacatgggcgccggcaccgagggcgccaacgccagctacatcctgatccgcgacacccacagcctgcgcaccaccgccttccacggccagcaggtgctgtactgggagagcgagagcagccaggccgagatggagttcagcgagggcttcctgaaggcccaggccagcctgcgcggccagtactggaccctgcagagctgggtgcccgagatgcaggacccccagagctggaagggcaaggagggcacc

SEQ ID NO: 1394 - DNA, 4020 bp, Artificial Sequence
  Description of Artificial Sequence: Synthetic coding sequence
atgcaccagcgccacccccgcgcccgctgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggccgcccccccagccccggcttccagcgccagcgccagcgccagcgccgcgccgccggcggcatcctgcacctggagctgctggtggccgtgggccccgacgtgttccaggcccaccaggaggacaccgagcgctacgtgctgaccaacctgaacatcggcgccgagctgctgcgcgaccccagcctgggcgcccagttccgcgtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcacccgcttcgacctggagctgcccgacggcaaccgccaggtgcgcggcgtgacccagctgggcggcgcctgcagccccacctggagctgcctgatcaccgaggacaccggcttcgacctgggcgtgaccatcgcccacgagatcggccacagcttcggcctggagcacgacggcgcccccggcagcggctgcggccccagcggccacgtgatggccagcgacggcgccgccccccgcgccggcctggcctggagcccctgcagccgccgccagctgctgagcctgctgagcgccaacgagcagtgccgcgtggccttcggccccaaggccgtggcctgcaccttcgcccgcgagcacctggacatgtgccaggccctgagctgccacaccgaccccctggaccagagcagctgcagccgcctgctggtgcccctgctggacggcaccgagtgcggcgtggagaagtggtgcagcaagggccgctgccgcagcctggtggagctgacccccatcgccgccgtgcacggccgctggagcagctggggcccccgcagcccctgcagccgcagctgcggcggcggcgtggtgacccgccgccgccagtgcaacaacccccgccccgccttcggcggccgcgcctgcgtgggcgccgacctgcaggccgagatgtgcaacacccaggcctgcgagaagacccagctggagttcatgagccagcagtgcgcccgcaccgacggccagcccctgcgcagcagccccggcggcgccagcttctaccactggggcgccgccgtgccccacagccagggcgacgccctgtgccgccacatgtgccgcgccatcggcgagagcttcatcatgaagcgcggcgacagcttcctggacggcacccgctgcatgcccagcggcccccgcgaggacggcaccctgagcctgtgcgtgagcggcagctgccgcaccttcggctgcgacggccgcatggacagccagcaggtgtgggaccgctgccaggtgtgcggcggcgacaacagcacctgcagcccccgcaagggcagcttcaccgccggccgcgcccgcgagtacgtgaccttcctgaccgtgacccccaacctgaccagcgtgtacatcgccaaccaccgccccctgttcacccacctggccgtgcgcatcggcggccgctacgtggtggccggcaagatgagcatcagccccaacaccacctaccccagcctgctggaggacggccgcgtggagtaccgcgtggccctgaccgaggaccgcctgccccgcctggaggagatccgcatctggggccccctgcaggaggacgccgacatccaggtgtaccgccgctacggcgaggagtacggcaacctgacccgccccgacatcaccttcacctacttccagcccaagccccgccaggcctgggtgtgggccgccgtgcgcggcccctgcagcgtgagctgcggcgccggcctgcgctgggtgaactacagctgcctggaccaggcccgcaaggagctggtggagaccgtgcagtgccagggcagccagcagccccccgcctggcccgaggcctgcgtgctggagccctgccccccctactgggccgtgggcgacttcggcccctgcagcgccagctgcggcggcggcctgcgcgagcgccccgtgcgctgcgtggaggcccagggcagcctgctgaagaccctgccccccgcccgctgccgcgccggcgcccagcagcccgccgtggccctggagacctgcaacccccagccctgccccgcccgctgggaggtgagcgagcccagcagctgcaccagcgccggcggcgccggcctggccctggagaacgagacctgcgtgcccggcgccgacggcctggaggcccccgtgaccgagggccccggcagcgtggacgagaagctgcccgcccccgagccctgcgtgggcatgagctgcccccccggctggggccacctggacgccaccagcgccggcgagaaggcccccagcccctggggcagcatccgcaccggcgcccaggccgcccacgtgtggacccccgccgccggcagctgcagcgtgagctgcggccgcggcctgatggagctgcgcttcctgtgcatggacagcgccctgcgcgtgcccgtgcaggaggagctgtgcggcctggccagcaagcccggcagccgccgcgaggtgtgccaggccgtgccctgccccgcccgctggcagtacaagctggccgcctgcagcgtgagctgcggccgcggcgtggtgcgccgcatcctgtactgcgcccgcgcccacggcgaggacgacggcgaggagatcctgctggacacccagtgccagggcctgccccgccccgagccccaggaggcctgcagcctggagccctgccccccccgctggaaggtgatgagcctgggcccctgcagcgccagctgcggcctgggcaccgcccgccgcagcgtggcctgcgtgcagctggaccagggccaggacgtggaggtggacgaggccgcctgcgccgccctggtgcgccccgaggccagcgtgccctgcctgatcgccgactgcacctaccgctggcacgtgggcacctggatggagtgcagcgtgagctgcggcgacggcatccagcgccgccgcgacacctgcctgggcccccaggcccaggcccccgtgcccgccgacttctgccagcacctgcccaagcccgtgaccgtgcgcggctgctgggccggcccctgcgtgggccagggcgcctgcggccgccagcacctggagcccaccggcaccatcgacatgcgcggccccggccaggccgactgcgccgtggccatcggccgccccctgggcgaggtggtgaccctgcgcgtgctggagagcagcctgaactgcagcgccggcgacatgctgctgctgtggggccgcctgacctggcgcaagatgtgccgcaagctgctggacatgaccttcagcagcaagaccaacaccctggtggtgcgccagcgctgcggccgccccggcggcggcgtgctgctgcgctacggcagccagctggcccccgagaccttctaccgcgagtgcgacatgcagctgttcggcccctggggcgagatcgtgagccccagcctgagccccgccaccagcaacgccggcggctgccgcctgttcatcaacgtggccccccacgcccgcatcgccatccacgccctggccaccaacatgggcgccggcaccgagggcgccaacgccagctacatcctgatccgcgacacccacagcctgcgcaccaccgccttccacggccagcaggtgctgtactgggagagcgagagcagccaggccgagatggagttcagcgagggcttcctgaaggcccaggccagcctgcgcggccagtactggaccctgcagagctgggtgcccgagatgcaggacccccagagctggaagggcaaggagggcacc

SEQ ID NO: 1395 - DNA, 669 bp, Artificial Sequence
  Description of Artificial Sequence: Synthetic coding sequence
atgcgcggccccggccaggccgactgcgccgtggccatcggccgccccctgggcgaggtggtgaccctgcgcgtgctggagagcagcctgaactgcagcgccggcgacatgctgctgctgtggggccgcctgacctggcgcaagatgtgccgcaagctgctggacatgaccttcagcagcaagaccaacaccctggtggtgcgccagcgctgcggccgccccggcggcggcgtgctgctgcgctacggcagccagctggcccccgagaccttctaccgcgagtgcgacatgcagctgttcggcccctggggcgagatcgtgagccccagcctgagccccgccaccagcaacgccggcggctgccgcctgttcatcaacgtggccccccacgcccgcatcgccatccacgccctggccaccaacatgggcgccggcaccgagggcgccaacgccagctacatcctgatccgcgacacccacagcctgcgcaccaccgccttccacggccagcaggtgctgtactgggagagcgagagcagccaggccgagatggagttcagcgagggcttcctgaaggcccaggccagcctgcgcggccagtactggaccctgcagagctgggtgcccgagatgcaggacccccagagctggaagggcaaggagggcacc

SEQ ID NO: 1396 - DNA, 1032 bp, Artificial Sequence
  Description of Artificial Sequence: Synthetic coding sequence
atgcaccagcgccacccccgcgcccgctgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggccgcccccccagccccggcttccagcgccagcgccagcgccagcgccgcgccgccggcggcatcctgcacctggagctgctggtggccgtgggccccgacgtgttccaggcccaccaggaggacaccgagcgctacgtgctgaccaacctgaacatcggcgccgagctgctgcgcgaccccagcctgggcgcccagttccgcgtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcacccgcttcgacctggagctgcccgacggcaaccgccaggtgcgcggcgtgacccagctgggcggcgcctgcagccccacctggagctgcctgatcaccgaggacaccggcttcgacctgggcgtgaccatcgcccacgagatcggccacagcttcggcctggagcacgacggcgcccccggcagcggctgcggccccagcggccacgtgatggccagcgacggcgccgccccccgcgccggcctggcctggagcccctgcagccgccgccagctgctgagcctgctgcgccccgtgccccccagccccctgcccctgctggccacccacctgtgcgccggccgcagcctgagcctgggccccagccaggagcccgcccccggcggcggccgcggcccccgcacccccgtgcccacccacaagcgcccccgcttccagaccctgcccagcagctgccccctgctgcgccccgccagcagccgctgcaccccccgcgac

SEQ ID NO: 1397 - DNA, 828 bp, Artificial Sequence
  Description of Artificial Sequence: Synthetic coding sequence
atgcaccagcgccacccccgcgcccgctgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggccgcccccccagccccggcttccagcgccagcgccagcgccagcgccgcgccgccggcggcatcctgcacctggagctgctggtggccgtgggccccgacgtgttccaggcccaccaggaggacaccgagcgctacgtgctgaccaacctgaacatcggcgccgagctgctgcgcgaccccagcctgggcgcccagttccgcgtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcacccgcttcgacctggagctgcccgacggcaaccgccaggtgcgcggcgtgacccagctgggcggcgcctgcagccccacctggagctgcctgatcaccgaggacaccggcttcgacctgggcgtgaccatcgcccacgagatcggccaccgcatctgcgcccgccccagccccgccacccagacccgctggaccaaggccgccgccgccgccagcagcttcctgagctggatgggccagaacgtggcctggcgcagcggcgccccccgcgtggccgccgccccctggtggagc

SEQ ID NO: 1398 - DNA, 4281 bp, Artificial Sequence
  Description of Artificial Sequence: Synthetic coding sequence
atgcaccagcgccacccccgcgcccgctgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggccgcccccccagccccggcttccagcgccagcgccagcgccagcgccgcgccgccggcggcatcctgcacctggagctgctggtggccgtgggccccgacgtgttccaggcccaccaggaggacaccgagcgctacgtgctgaccaacctgaacatcggcgccgagctgctgcgcgaccccagcctgggcgcccagttccgcgtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcacccgcttcgacctggagctgcccgacggcaaccgccaggtgcgcggcgtgacccagctgggcggcgcctgcagccccacctggagctgcctgatcaccgaggacaccggcttcgacctgggcgtgaccatcgcccacgagatcggccacagcttcggcctggagcacgacggcgcccccggcagcggctgcggccccagcggccacgtgatggccagcgacggcgccgccccccgcgccggcctggcctggagcccctgcagccgccgccagctgctgagcctgctgagcgccggccgcgcccgctgcgtgtgggaccccccccgcccccagcccggcagcgccggccacccccccgacgcccagcccggcctgtactacagcgccaacgagcagtgccgcgtggccttcggccccaaggccgtggcctgcaccttcgcccgcgagcacctggacatgtgccaggccctgagctgccacaccgaccccctggaccagagcagctgcagccgcctgctggtgcccctgctggacggcaccgagtgcggcgtggagaagtggtgcagcaagggccgctgccgcagcctggtggagctgacccccatcgccgccgtgcacggccgctggagcagctggggcccccgcagcccctgcagccgcagctgcggcggcggcgtggtgacccgccgccgccagtgcaacaacccccgccccgccttcggcggccgcgcctgcgtgggcgccgacctgcaggccgagatgtgcaacacccaggcctgcgagaagacccagctggagttcatgagccagcagtgcgcccgcaccgacggccagcccctgcgcagcagccccggcggcgccagcttctaccactggggcgccgccgtgccccacagccagggcgacgccctgtgccgccacatgtgccgcgccatcggcgagagcttcatcatgaagcgcggcgacagcttcctggacggcacccgctgcatgcccagcggcccccgcgaggacggcaccctgagcctgtgcgtgagcggcagctgccgcaccttcggctgcgacggccgcatggacagccagcaggtgtgggaccgctgccaggtgtgcggcggcgacaacagcacctgcagcccccgcaagggcagcttcaccgccggccgcgcccgcgagtacgtgaccttcctgaccgtgacccccaacctgaccagcgtgtacatcgccaaccaccgccccctgttcacccacctggccgtgcgcatcggcggccgctacgtggtggccggcaagatgagcatcagccccaacaccacctaccccagcctgctggaggacggccgcgtggagtaccgcgtggccctgaccgaggaccgcctgccccgcctggaggagatccgcatctggggccccctgcaggaggacgccgacatccaggtgtaccgccgctacggcgaggagtacggcaacctgacccgccccgacatcaccttcacctacttccagcccaagccccgccaggcctgggtgtgggccgccgtgcgcggcccctgcagcgtgagctgcggcgccggcctgcgctgggtgaactacagctgcctggaccaggcccgcaaggagctggtggagaccgtgcagtgccagggcagccagcagccccccgcctggcccgaggcctgcgtgctggagccctgccccccctactgggccgtgggcgacttcggcccctgcagcgccagctgcggcggcggcctgcgcgagcgccccgtgcgctgcgtggaggcccagggcagcctgctgaagaccctgccccccgcccgctgccgcgccggcgcccagcagcccgccgtggccctggagacctgcaacccccagccctgccccgcccgctgggaggtgagcgagcccagcagctgcaccagcgccggcggcgccggcctggccctggagaacgagacctgcgtgcccggcgccgacggcctggaggcccccgtgaccgagggccccggcagcgtggacgagaagctgcccgcccccgagccctgcgtgggcatgagctgcccccccggctggggccacctggacgccaccagcgccggcgagaaggcccccagcccctggggcagcatccgcaccggcgcccaggccgcccacgtgtggacccccgccgccggcagctgcagcgtgagctgcggccgcggcctgatggagctgcgcttcctgtgcatggacagcgccctgcgcgtgcccgtgcaggaggagctgtgcggcctggccagcaagcccggcagccgccgcgaggtgtgccaggccgtgccctgccccgcccgctggcagtacaagctggccgcctgcagcgtgagctgcggccgcggcgtggtgcgccgcatcctgtactgcgcccgcgcccacggcgaggacgacggcgaggagatcctgctggacacccagtgccagggcctgccccgccccgagccccaggaggcctgcagcctggagccctgccccccccgctggaaggtgatgagcctgggcccctgcagcgccagctgcggcctgggcaccgcccgccgcagcgtggcctgcgtgcagctggaccagggccaggacgtggaggtggacgaggccgcctgcgccgccctggtgcgccccgaggccagcgtgccctgcctgatcgccgactgcacctaccgctggcacgtgggcacctggatggagtgcagcgtgagctgcggcgacggcatccagcgccgccgcgacacctgcctgggcccccaggcccaggcccccgtgcccgccgacttctgccagcacctgcccaagcccgtgaccgtgcgcggctgctgggccggcccctgcgtgggccagggcacccccagcctggtgccccacgaggaggccgccgcccccggccgcaccaccgccacccccgccggcgccagcctggagtggagccaggcccgcggcctgctgttcagccccgccccccagccccgccgcctgctgcccggcccccaggagaacagcgtgcagagcagcgcctgcggccgccagcacctggagcccaccggcaccatcgacatgcgcggccccggccaggccgactgcgccgtggccatcggccgccccctgggcgaggtggtgaccctgcgcgtgctggagagcagcctgaactgcagcgccggcgacatgctgctgctgtggggccgcctgacctggcgcaagatgtgccgcaagctgctggacatgaccttcagcagcaagaccaacaccctggtggtgcgccagcgctgcggccgccccggcggcggcgtgctgctgcgctacggcagccagctggcccccgagaccttctaccgcgagtgcgacatgcagctgttcggcccctggggcgagatcgtgagccccagcctgagccccgccaccagcaacgccggcggctgccgcctgttcatcaacgtggccccccacgcccgcatcgccatccacgccctggccaccaacatgggcgccggcaccgagggcgccaacgccagctacatcctgatccgcgacacccacagcctgcgcaccaccgccttccacggccagcaggtgctgtactgggagagcgagagcagccaggccgagatggagttcagcgagggcttcctgaaggcccaggccagcctgcgcggccagtactggaccctgcagagctgggtgcccgagatgcaggacccccagagctggaagggcaaggagggcacc

SEQ ID NO: 1399 - DNA, 1092 bp, Artificial Sequence
  Description of Artificial Sequence: Synthetic coding sequence
atggacatgtgccaggccctgagctgccacaccgaccccctggaccagagcagctgcagccgcctgctggtgcccctgctggacggcaccgagtgcggcgtggagaagtggtgcagcaagggccgctgccgcagcctggtggagctgacccccatcgccgccgtgcacggccgctggagcagctggggcccccgcagcccctgcagccgcagctgcggcggcggcgtggtgacccgccgccgccagtgcaacaacccccgccccgccttcggcggccgcgcctgcgtgggcgccgacctgcaggccgagatgtgcaacacccaggcctgcgagaagacccagctggagttcatgagccagcagtgcgcccgcaccgacggccagcccctgcgcagcagccccggcggcgccagcttctaccactggggcgccgccgtgccccacagccagggcgacgccctgtgccgccacatgtgccgcgccatcggcgagagcttcatcatgaagcgcggcgacagcttcctggacggcacccgctgcatgcccagcggcccccgcgaggacggcaccctgagcctgtgcgtgagcggcagctgccgcaccttcggctgcgacggccgcatggacagccagcaggtgtgggaccgctgccaggtgtgcggcggcgacaacagcacctgcagcccccgcaagggcagcttcaccgccggccgcgcccgcgagtacgtgaccttcctgaccgtgacccccaacctgaccagcgtgtacatcgccaaccaccgccccctgttcacccacctggccgtgcgcatcggcggccgctacgtggtggccggcaagatgagcatcagccccaacaccacctaccccagcctgctggaggacggccgcgtggagtaccgcgtggccctgaccgaggaccgcctgccccgcctggaggagatccgcatctggggccccctgcaggaggacgccgacatccaggtgggcggcgtgcgcgcccagctgatgcacatcagctggtggagccgccccggcctgggcgagcgcgacctgtgcgcccgcggccgctggcccggcggcagcagcgac

SEQ ID NO: 1400 - DNA, 801 bp, Artificial Sequence
  Description of Artificial Sequence: Synthetic coding sequence
atgaaggccgccgtgctgaccctggccgtgctgttcctgaccggcagccaggcccgccacttctggcagcaggacgagcccccccagagcccctgggaccgcgtgaaggacctggccaccgtgtacgtggacgtgctgaaggacagcggccgcgactacgtgagccagttcgagggcagcgccctgggcaagcagctgaacctgaagctgctggacaactgggacagcgtgaccagcaccttcagcaagctgcgcgagcagctgggccccgtgacccaggagttctgggacaacctggagaaggagaccgagggcctgcgccaggagatgagcaaggacctggaggaggtgaaggccaaggtgcagccctacctggacgacttccagaagaagtggcaggaggagatggagctgtaccgccagaaggtggagcccctgcgcgccgagctgcaggagggcgcccgccagaagctgcacgagctgcaggagaagctgagccccctgggcgaggagatgcgcgaccgcgcccgcgcccacgtggacgccctgcgcacccacctggccccctacagcgacgagctgcgccagtgcctggccgcccgcctggaggccctgaaggagaacggcggcgcccgcctggccgagtaccacgccaaggccaccgagcacctgagcaccctgagcgagaaggccaagcccgccctggaggacctgcgccagggcctgctgcccgtgctggagagcttcaaggtgagcttcctgagcgccctggaggagtacaccaagaagctgaacacccag

SEQ ID NO: 1401 - DNA, 801 bp, Artificial Sequence
  Description of Artificial Sequence: Synthetic coding sequence
atgaaggccgccgtgctgaccctggccgtgctgttcctgaccggcagccaggcccgccacttctggcagcaggacgagcccccccagagcccctgggaccgcgtgaaggacctggccaccgtgtacgtggacgtgctgaaggacagcggccgcgactacgtgagccagttcgagggcagcgccctgggcaagcagctgaacctgaagctgctggacaactgggacagcgtgaccagcaccttcagcaagctgcgcgagcagctgggccccgtgacccaggagttctgggacaacctggagaaggagaccgagggcctgcgccaggagatgagcaaggacctggaggaggtgaaggccaaggtgcagccctacctggacgacttccagaagaagtggcaggaggagatggagctgtaccgccagaaggtggagcccctgcgcgccgagctgcaggagggcgcccgccagaagctgcacgagctgcaggagaagctgagccccctgggcgaggagatgcgcgactgcgcccgcgcccacgtggacgccctgcgcacccacctggccccctacagcgacgagctgcgccagcgcctggccgcccgcctggaggccctgaaggagaacggcggcgcccgcctggccgagtaccacgccaaggccaccgagcacctgagcaccctgagcgagaaggccaagcccgccctggaggacctgcgccagggcctgctgcccgtgctggagagcttcaaggtgagcttcctgagcgccctggaggagtacaccaagaagctgaacacccag

SEQ ID NO: 1402 - DNA, 801 bp, Artificial Sequence
  Description of Artificial Sequence: Synthetic coding sequence
atgaaggccgccgtgctgaccctggccgtgctgttcctgaccggcagccaggcccgccacttctggcagcaggacgagcccccccagagcccctgggaccgcgtgaaggacctggccaccgtgtacgtggacgtgctgaaggacagcggccgcgactacgtgagccagttcgagggcagcgccctgggcaagcagctgaacctgaagctgctggacaactgggacagcgtgaccagcaccttcagcaagctgcgcgagcagctgggccccgtgacccaggagttctgggacaacctggagaaggagaccgagggcctgcgccaggagatgagcaaggacctggaggaggtgaaggccaaggtgcagccctacctggacgacttccagaagaagtggcaggaggagatggagctgtaccgccagaaggtggagcccctgcgcgccgagctgcaggagggcgcccgccagaagctgcacgagctgcaggagaagctgagccccctgggcgaggagatgcgcgaccgcgcccgcgcccacgtggacgccctgcgcacccacctggccccctacagcgacgagctgcgccagcgcctggccgcccgcctggaggccctgaaggagaacggcggcgcccgcctggccgagtaccacgccaaggccaccgagcacctgagcaccctgagcgagaaggccaagcccgccctggaggacctgcgccagggcctgctgcccgtgctggagagcttcaaggtgagcttcctgagcgccctggaggagtacaccaagaagctgaacacccag

SEQ ID NO: 1403 - DNA, 1236 bp, Artificial Sequence
  Description of Artificial Sequence: Synthetic coding sequence
atgagcagcaagggcagcgtggtgctggcctacagcggcggcctggacaccagctgcatcctggtgtggctgaaggagcagggctacgacgtgatcgcctacctggccaacatcggccagaaggaggacttcgaggaggcccgcaagaaggccctgaagctgggcgccaagaaggtgttcatcgaggacgtgagccgcgagttcgtggaggagttcatctggcccgccatccagagcagcgccctgtacgaggaccgctacctgctgggcaccagcctggcccgcccctgcatcgcccgcaagcaggtggagatcgcccagcgcgagggcgccaagtacgtgagccacggcgccaccggcaagggcaacgaccaggtgcgcttcgagctgagctgctacagcctggccccccagatcaaggtgatcgccccctggcgcatgcccgagttctacaaccgcttcaagggccgcaacgacctgatggagtacgccaagcagcacggcatccccatccccgtgacccccaagaacccctggagcatggacgagaacctgatgcacatcagctacgaggccggcatcctggagaaccccaagaaccaggccccccccggcctgtacaccaagacccaggaccccgccaaggcccccaacacccccgacatcctggagatcgagttcaagaagggcgtgcccgtgaaggtgaccaacgtgaaggacggcaccacccaccagaccagcctggagctgttcatgtacctgaacgaggtggccggcaagcacggcgtgggccgcatcgacatcgtggagaaccgcttcatcggcatgaagagccgcggcatctacgagacccccgccggcaccatcctgtaccacgcccacctggacatcgaggccttcaccatggaccgcgaggtgcgcaagatcaagcagggcctgggcctgaagttcgccgagctggtgtacaccggcttctggcacagccccgagtgcgagttcgtgcgccactgcatcgccaagagccaggagcgcgtggagggcaaggtgcaggtgagcgtgctgaagggccaggtgtacatcctgggccgcgagagccccctgagcctgtacaacgaggagctggtgagcatgaacgtgcagggcgactacgagcccaccgacgccaccggcttcatcaacatcaacagcctgcgcctgaaggagtaccaccgcctgcagagcaaggtgaccgccaag

SEQ ID NO: 1404 - DNA, 507 bp, Artificial Sequence
  Description of Artificial Sequence: Synthetic coding sequence
gagcccggccccctgcagctgatggtggtggccgaggcccagggcggcaagcacggcgtgggccgcatcgacatcgtggagaaccgcttcatcggcatgaagagccgcggcatctacgagacccccgccggcaccatcctgtaccacgcccacctggacatcgaggccttcaccatggaccgcgaggtgcgcaagatcaagcagggcctgggcctgaagttcgccgagctggtgtacaccggcttctggcacagccccgagtgcgagttcgtgcgccactgcatcgccaagagccaggagcgcgtggagggcaaggtgcaggtgagcgtgctgaagggccaggtgtacatcctgggccgcgagagccccctgagcctgtacaacgaggagctggtgagcatgaacgtgcagggcgactacgagcccaccgacgccaccggcttcatcaacatcaacagcctgcgcctgaaggagtaccaccgcctgcagagcaaggtgaccgccaag

SEQ ID NO: 1405 - DNA, 594 bp, Artificial Sequence
  Description of Artificial Sequence: Synthetic coding sequence
atgagcagcaagggcagcgtggtgctggcctacagcggcggcctggacaccagctgcatcctggtgtggctgaaggagcagggctacgacgtgatcgcctacctggccaacatcggccagaaggaggacttcgaggaggcccgcaagaaggccctgaagctgggcgccaagaaggtgttcatcgaggacgtgagccgcgagttcgtggaggagttcatctggcccgccatccagagcagcgccctgtacgaggaccgctacctgctgggcaccagcctggcccgcccctgcatcgcccgcaagcaggtggagatcgcccagcgcgagggcgccaagtacgtgagccacggcgccaccggcaagggcaacgaccaggtgcgcttcgagctgagctgctacagcctggccccccagatcaaggtgatcgccccctggcgcatgcccgagttctacaaccgcttcaagggccgcaacgacctgatggagtacgccaagcagcacggcatccccatccccgtgacccccaagaacccctggagcatggacgagaacctgatgcacatcagctacgaggccggcatcctggagaacccc

SEQ ID NO: 1406 - DNA, 537 bp, Artificial Sequence
  Description of Artificial Sequence: Synthetic coding sequence
atgagcagcaagggcagcgtggtgctggcctacagcggcggcctggacaccagctgcatcctggtgtggctgaaggagcagggctacgacgtgatcgcctacctggccaacatcggccagaaggaggacttcgaggaggcccgcaagaaggccctgaagctgggcgccaagaaggtgttcatcgaggacgtgagccgcgagttcgtggaggagttcatctggcccgccatccagagcagcgccctgtacgaggaccgctacctgctgggcaccagcctggcccgcccctgcatcgcccgcaagcaggtggagatcgcccagcgcgagggcgccaagtacgtgagccacggcgccaccggcaaggtgatcgccccctggcgcatgcccgagttctacaaccgcttcaagggccgcaacgacctgatggagtacgccaagcagcacggcatccccatccccgtgacccccaagaacccctggagcatggacgagaacctgatgcacatcagctacgaggccggcatcctggagaacccc

SEQ ID NO: 1407 - DNA, 3753 bp, Artificial Sequence
  Description of Artificial Sequence: Synthetic coding sequence
atgagcaccgagcgcgacagcgagaccaccttcgacgaggacagccagcccaacgacgaggtggtgccctacagcgacgacgagaccgaggacgagctggacgaccagggcagcgccgtggagcccgagcagaaccgcgtgaaccgcgaggccgaggagaaccgcgagcccttccgcaaggagtgcacctggcaggtgaaggccaacgaccgcaagtaccacgagcagccccacttcatgaacaccaagttcctgtgcatcaaggagagcaagtacgccaacaacgccatcaagacctacaagtacaacgccttcaccttcatccccatgaacctgttcgagcagttcaagcgcgccgccaacctgtacttcctggccctgctgatcctgcaggccgtgccccagatcagcaccctggcctggtacaccaccctggtgcccctgctggtggtgctgggcgtgaccgccatcaaggacctggtggacgacgtggcccgccacaagatggacaaggagatcaacaaccgcacctgcgaggtgatcaaggacggccgcttcaaggtggccaagtggaaggagatccaggtgggcgacgtgatccgcctgaagaagaacgacttcgtgcccgccgacatcctgctgctgagcagcagcgagcccaacagcctgtgctacgtggagaccgccgagctggacggcgagaccaacctgaagttcaagatgagcctggagatcaccgaccagtacctgcagcgcgaggacaccctggccaccttcgacggcttcatcgagtgcgaggagcccaacaaccgcctggacaagttcaccggcaccctgttctggcgcaacaccagcttccccctggacgccgacaagatcctgctgcgcggctgcgtgatccgcaacaccgacttctgccacggcctggtgatcttcgccggcgccgacaccaagatcatgaagaacagcggcaagacccgcttcaagcgcaccaagatcgactacctgatgaactacatggtgtacaccatcttcgtggtgctgatcctgctgagcgccggcctggccatcggccacgcctactgggaggcccaggtgggcaacagcagctggtacctgtacgacggcgaggacgacacccccagctaccgcggcttcctgatcttctggggctacatcatcgtgctgaacaccatggtgcccatcagcctgtacgtgagcgtggaggtgatccgcctgggccagagccacttcatcaactgggacctgcagatgtactacgccgagaaggacacccccgccaaggcccgcaccaccaccctgaacgagcagctgggccagatccactacatcttcagcgacaagaccggcaccctgacccagaacatcatgaccttcaagaagtgctgcatcaacggccagatctacggcgaccaccgcgacgccagccagcacaaccacaacaagatcgagcaggtggacttcagctggaacacctacgccgacggcaagctggccttctacgaccactacctgatcgagcagatccagagcggcaaggagcccgaggtgcgccagttcttcttcctgctggccgtgtgccacaccgtgatggtggaccgcaccgacggccagctgaactaccaggccgccagccccgacgagggcgccctggtgaacgccgcccgcaacttcggcttcgccttcctggcccgcacccagaacaccatcaccatcagcgagctgggcaccgagcgcacctacaacgtgctggccatcctggacttcaacagcgaccgcaagcgcatgagcatcatcgtgcgcacccccgagggcaacatcaagctgtactgcaagggcgccgacaccgtgatctacgagcgcctgcaccgcatgaaccccaccaagcaggagacccaggacgccctggacatcttcgccaacgagaccctgcgcaccctgtgcctgtgctacaaggagatcgaggagaaggagttcaccgagtggaacaagaagttcatggccgccagcgtggccagcaccaaccgcgacgaggccctggacaaggtgtacgaggagatcgagaaggacctgatcctgctgggcgccaccgccatcgaggacaagctgcaggacggcgtgcccgagaccatcagcaagctggccaaggccgacatcaagatctgggtgctgaccggcgacaagaaggagaccgccgagaacatcggcttcgcctgcgagctgctgaccgaggacaccaccatctgctacggcgaggacatcaacagcctgctgcacgcccgcatggagaaccagcgcaaccgcggcggcgtgtacgccaagttcgccccccccgtgcaggagagcttcttcccccccggcggcaaccgcgccctgatcatcaccggcagctggctgaacgagatcctgctggagaagaagaccaagcgcaacaagatcctgaagctgaagttcccccgcaccgaggaggagcgccgcatgcgcacccagagcaagcgccgcctggaggccaagaaggagcagcgccagaagaacttcgtggacctggcctgcgagtgcagcgccgtgatctgctgccgcgtgacccccaagcagaaggccatggtggtggacctggtgaagcgctacaagaaggccatcaccctggccatcggcgacggcgccaacgacgtgaacatgatcaagaccgcccacatcggcgtgggcatcagcggccaggagggcatgcaggccgtgatgagcagcgactacagcttcgcccagttccgctacctgcagcgcctgctgctggtgcacggccgctggagctacatccgcatgtgcaagttcctgcgctacttcttctacaagaacttcgccttcaccctggtgcacttctggtacagcttcttcaacggctacagcgcccagaccgcctacgaggactggttcatcaccctgtacaacgtgctgtacaccagcctgcccgtgctgctgatgggcctgctggaccaggacgtgagcgacaagctgagcctgcgcttccccggcctgtacatcgtgggccagcgcgacctgctgttcaactacaagcgcttcttcgtgagcctgctgcacggcgtgctgaccagcatgatcctgttcttcatccccctgggcgcctacctgcagaccgtgggccaggacggcgaggcccccagcgactaccagagcttcgccgtgaccatcgccagcgccctggtgatcaccgtgaacttccagatcggcctggacaccagctactggaccttcgtgaacgccttcagcatcttcggcagcatcgccctgtacttcggcatcatgttcgacttccacagcgccggcatccacgtgctgttccccagcgccttccagttcaccggcaccgccagcaacgccctgcgccagccctacatctggctgaccatcatcctggccgtggccgtgtgcctgctgcccgtggtggccatccgcttcctgagcatgaccatctggcccagcgagagcgacaagatccagaagcaccgcaagcgcctgaaggccgaggagcagtggcagcgccgccagcaggtgttccgccgcggcgtgagcacccgccgcagcgcctacgccttcagccaccagcgcggctacgccgacctgatcagcagcggccgcagcatccgcaagaagcgcagccccctggacgccatcgtggccgacggcaccgccgagtaccgccgcaccggcgacagc

SEQ ID NO: 1408 - DNA, 3963 bp, Artificial Sequence
  Description of Artificial Sequence: Synthetic coding sequence
atgagcgacagcgtgatcctgcgcagcatcaagaagttcggcgaggagaacgacggcttcgagagcgacaagagctacaacaacgacaagaagagccgcctgcaggacgagaagaagggcgacggcgtgcgcgtgggcttcttccagctgttccgcttcagcagcagcaccgacatctggctgatgttcgtgggcagcctgtgcgccttcctgcacggcatcgcccagcccggcgtgctgctgatcttcggcaccatgaccgacgtgttcatcgactacgacgtggagctgcaggagctgcagatccccggcaaggcctgcgtgaacaacaccatcgtgtggaccaacagcagcctgaaccagaacatgaccaacggcacccgctgcggcctgctgaacatcgagagcgagatgatcaagttcgccagctactacgccggcatcgccgtggccgtgctgatcaccggctacatccagatctgcttctgggtgatcgccgccgcccgccagatccagaagatgcgcaagttctacttccgccgcatcatgcgcatggagatcggctggttcgactgcaacagcgtgggcgagctgaacacccgcttcagcgacgacatcaacaagatcaacgacgccatcgccgaccagatggccctgttcatccagcgcatgaccagcaccatctgcggcttcctgctgggcttcttccgcggctggaagctgaccctggtgatcatcagcgtgagccccctgatcggcatcggcgccgccaccatcggcctgagcgtgagcaagttcaccgactacgagctgaaggcctacgccaaggccggcgtggtggccgacgaggtgatcagcagcatgcgcaccgtggccgccttcggcggcgagaagcgcgaggtggagcgctacgagaagaacctggtgttcgcccagcgctggggcatccgcaagggcatcgtgatgggcttcttcaccggcttcgtgtggtgcctgatcttcctgtgctacgccctggccttctggtacggcagcaccctggtgctggacgagggcgagtacacccccggcaccctggtgcagatcttcctgagcgtgatcgtgggcgccctgaacctgggcaacgccagcccctgcctggaggccttcgccaccggccgcgccgccgccaccagcatcttcgagaccatcgaccgcaagcccatcatcgactgcatgagcgaggacggctacaagctggaccgcatcaagggcgagatcgagttccacaacgtgaccttccactaccccagccgccccgaggtgaagatcctgaacgacctgaacatggtgatcaagcccggcgagatgaccgccctggtgggccccagcggcgccggcaagagcaccgccctgcagctgatccagcgcttctacgacccctgcgagggcatggtgaccgtggacggccacgacatccgcagcctgaacatccagtggctgcgcgaccagatcggcatcgtggagcaggagcccgtgctgttcagcaccaccatcgccgagaacatccgctacggccgcgaggacgccaccatggaggacatcgtgcaggccgccaaggaggccaacgcctacaacttcatcatggacctgccccagcagttcgacaccctggtgggcgagggcggcggccagatgagcggcggccagaagcagcgcgtggccatcgcccgcgccctgatccgcaaccccaagatcctgctgctggacatggccaccagcgccctggacaacgagagcgaggccatggtgcaggaggtgctgagcaagatccagcacggccacaccatcatcagcgtggcccaccgcctgagcaccgtgcgcgccgccgacaccatcatcggcttcgagcacggcaccgccgtggagcgcggcacccacgaggagctgctggagcgcaagggcgtgtacttcaccctggtgaccctgcagagccagggcaaccaggccctgaacgaggaggacatcaaggacgccaccgaggacgacatgctggcccgcaccttcagccgcggcagctaccaggacagcctgcgcgccagcatccgccagcgcagcaagagccagctgagctacctggtgcacgagccccccctggccgtggtggaccacaagagcacctacgaggaggaccgcaaggacaaggacatccccgtgcaggaggaggtggagcccgcccccgtgcgccgcatcctgaagttcagcgcccccgagtggccctacatgctggtgggcagcgtgggcgccgccgtgaacggcaccgtgacccccctgtacgccttcctgttcagccagatcctgggcaccttcagcatccccgacaaggaggagcagcgcagccagatcaacggcgtgtgcctgctgttcgtggccatgggctgcgtgagcctgttcacccagttcctgcagggctacgccttcgccaagagcggcgagctgctgaccaagcgcctgcgcaagttcggcttccgcgccatgctgggccaggacatcgcctggttcgacgacctgcgcaacagccccggcgccctgaccacccgcctggccaccgacgccagccaggtgcagggcgccgccggcagccagatcggcatgatcgtgaacagcttcaccaacgtgaccgtggccatgatcatcgccttcagcttcagctggaagctgagcctggtgatcctgtgcttcttccccttcctggccctgagcggcgccacccagacccgcatgctgaccggcttcgccagccgcgacaagcaggccctggagatggtgggccagatcaccaacgaggccctgagcaacatccgcaccgtggccggcatcggcaaggagcgccgcttcatcgaggccctggagaccgagctggagaagcccttcaagaccgccatccagaaggccaacatctacggcttctgcttcgccttcgcccagtgcatcatgttcatcgccaacagcgccagctaccgctacggcggctacctgatcagcaacgagggcctgcacttcagctacgtgttccgcgtgatcagcgccgtggtgctgagcgccaccgccctgggccgcgccttcagctacacccccagctacgccaaggccaagatcagcgccgcccgcttcttccagctgctggaccgccagccccccatcagcgtgtacaacaccgccggcgagaagtgggacaacttccagggcaagatcgacttcgtggactgcaagttcacctaccccagccgccccgacagccaggtgctgaacggcctgagcgtgagcatcagccccggccagaccctggccttcgtgggcagcagcggctgcggcaagagcaccagcatccagctgctggagcgcttctacgaccccgaccagggcaaggtgatgatcgacggccacgacagcaagaaggtgaacgtgcagttcctgcgcagcaacatcggcatcgtgagccaggagcccgtgctgttcgcctgcagcatcatggacaacatcaagtacggcgacaacaccaaggagatccccatggagcgcgtgatcgccgccgccaagcaggcccagctgcacgacttcgtgatgagcctgcccgagaagtacgagaccaacgtgggcagccagggcagccagctgagccgcggcgagaagcagcgcatcgccatcgcccgcgccatcgtgcgcgaccccaagatcctgctgctggacgaggccaccagcgccctggacaccgagagcgagaagaccgtgcaggtggccctggacaaggcccgcgagggccgcacctgcatcgtgatcgcccaccgcctgagcaccatccagaacgccgacatcatcgccgtgatggcccagggcgtggtgatcgagaagggcacccacgaggagctgatggcccagaagggcgcctactacaagctggtgaccaccggcagccccatcagc

SEQ ID NO: 1409 - DNA, 3858 bp, Artificial Sequence
  Description of Artificial Sequence: Synthetic coding sequence
atggacctggaggccgccaagaacggcaccgcctggcgccccaccagcgccgagggcgacttcgagctgggcatcagcagcaagcagaagcgcaagaagaccaagaccgtgaagatgatcggcgtgctgaccctgttccgctacagcgactggcaggacaagctgttcatgagcctgggcaccatcatggccatcgcccacggcagcggcctgcccctgatgatgatcgtgttcggcgagatgaccgacaagttcgtggacaccgccggcaacttcagcttccccgtgaacttcagcctgagcctgctgaaccccggcaagatcctggaggaggagatgacccgctacgcctactactacagcggcctgggcgccggcgtgctggtggccgcctacatccaggtgagcttctggaccctggccgccggccgccagatccgcaagatccgccagaagttcttccacgccatcctgcgccaggagatcggctggttcgacatcaacgacaccaccgagctgaacacccgcctgaccgacgacatcagcaagatcagcgagggcatcggcgacaaggtgggcatgttcttccaggccgtggccaccttcttcgccggcttcatcgtgggcttcatccgcggctggaagctgaccctggtgatcatggccatcagccccatcctgggcctgagcgccgccgtgtgggccaagatcctgagcgccttcagcgacaaggagctggccgcctacgccaaggccggcgccgtggccgaggaggccctgggcgccatccgcaccgtgatcgccttcggcggccagaacaaggagctggagcgctaccagaagcacctggagaacgccaaggagatcggcatcaagaaggccatcagcgccaacatcagcatgggcatcgccttcctgctgatctacgccagctacgccctggccttctggtacggcagcaccctggtgatcagcaaggagtacaccatcggcaacgccatgaccgtgttcttcagcatcctgatcggcgccttcagcgtgggccaggccgccccctgcatcgacgccttcgccaacgcccgcggcgccgcctacgtgatcttcgacatcatcgacaacaaccccaagatcgacagcttcagcgagcgcggccacaagcccgacagcatcaagggcaacctggagttcaacgacgtgcacttcagctaccccagccgcgccaacgtgaagatcctgaagggcctgaacctgaaggtgcagagcggccagaccgtggccctggtgggcagcagcggctgcggcaagagcaccaccgtgcagctgatccagcgcctgtacgaccccgacgagggcaccatcaacatcgacggccaggacatccgcaacttcaacgtgaactacctgcgcgagatcatcggcgtggtgagccaggagcccgtgctgttcagcaccaccatcgccgagaacatctgctacggccgcggcaacgtgaccatggacgagatcaagaaggccgtgaaggaggccaacgcctacgagttcatcatgaagctgccccagaagttcgacaccctggtgggcgagcgcggcgcccagctgagcggcggccagaagcagcgcatcgccatcgcccgcgccctggtgcgcaaccccaagatcctgctgctggacgaggccaccagcgccctggacaccgagagcgaggccgaggtgcaggccgccctggacaaggcccgcgagggccgcaccaccatcgtgatcgcccaccgcctgagcaccgtgcgcaacgccgacgtgatcgccggcttcgaggacggcgtgatcgtggagcagggcagccacagcgagctgatgaagaaggagggcgtgtacttcaagctggtgaacatgcagaccagcggcagccagatccagagcgaggagttcgagctgaacgacgagaaggccgccacccgcatggcccccaacggctggaagagccgcctgttccgccacagcacccagaagaacctgaagaacagccagatgtgccagaagagcctggacgtggagaccgacggcctggaggccaacgtgccccccgtgagcttcctgaaggtgctgaagctgaacaagaccgagtggccctacttcgtggtgggcaccgtgtgcgccatcgccaacggcggcctgcagcccgccttcagcgtgatcttcagcgagatcatcgccatcttcggccccggcgacgacgccgtgaagcagcagaagtgcaacatcttcagcctgatcttcctgttcctgggcatcatcagcttcttcaccttcttcctgcagggcttcaccttcggcaaggccggcgagatcctgacccgccgcctgcgcagcatggccttcaaggccatgctgcgccaggacatgagctggttcgacgaccacaagaacagcaccggcgccctgagcacccgcctggccaccgacgccgcccaggtgcagggcgccaccggcacccgcctggccctgatcgcccagaacatcgccaacctgggcaccggcatcatcatcagcttcatctacggctggcagctgaccctgctgctgctggccgtggtgcccatcatcgccgtgagcggcatcgtggagatgaagctgctggccggcaacgccaagcgcgacaagaaggagctggaggccgccggcaagatcgccaccgaggccatcgagaacatccgcaccgtggtgagcctgacccaggagcgcaagttcgagagcatgtacgtggagaagctgtacggcccctaccgcaacagcgtgcagaaggcccacatctacggcatcaccttcagcatcagccaggccttcatgtacttcagctacgccggctgcttccgcttcggcgcctacctgatcgtgaacggccacatgcgcttccgcgacgtgatcctggtgttcagcgccatcgtgttcggcgccgtggccctgggccacgccagcagcttcgcccccgactacgccaaggccaagctgagcgccgcccacctgttcatgctgttcgagcgccagcccctgatcgacagctacagcgaggagggcctgaagcccgacaagttcgagggcaacatcaccttcaacgaggtggtgttcaactaccccacccgcgccaacgtgcccgtgctgcagggcctgagcctggaggtgaagaagggccagaccctggccctggtgggcagcagcggctgcggcaagagcaccgtggtgcagctgctggagcgcttctacgaccccctggccggcaccgtgttcgtggacttcggcttccagctgctggacggccaggaggccaagaagctgaacgtgcagtggctgcgcgcccagctgggcatcgtgagccaggagcccatcctgttcgactgcagcatcgccgagaacatcgcctacggcgacaacagccgcgtggtgagccaggacgagatcgtgagcgccgccaaggccgccaacatccaccccttcatcgagaccctgccccacaagtacgagacccgcgtgggcgacaagggcacccagctgagcggcggccagaagcagcgcatcgccatcgcccgcgccctgatccgccagccccagatcctgctgctggacgaggccaccagcgccctggacaccgagagcgagaaggtggtgcaggaggccctggacaaggcccgcgagggccgcacctgcatcgtgatcgcccaccgcctgagcaccatccagaacgccgacctgatcgtggtgttccagaacggccgcgtgaaggagcacggcacccaccagcagctgctggcccagaagggcatctacttcagcatggtgagcgtgcaggccggcacccagaacctg

SEQ ID NO: 1410 - DNA, 3696 bp, Artificial Sequence
  Description of Artificial Sequence: Synthetic coding sequence
atggacctggaggccgccaagaacggcaccgcctggcgccccaccagcgccgagggcgacttcgagctgggcatcagcagcaagcagaagcgcaagaagaccaagaccgtgaagatgatcggcgtgctgaccctgttccgctacagcgactggcaggacaagctgttcatgagcctgggcaccatcatggccatcgcccacggcagcggcctgcccctgatgatgatcgtgttcggcgagatgaccgacaagttcgtggacaccgccggcaacttcagcttccccgtgaacttcagcctgagcctgctgaaccccggcaagatcctggaggaggagatgacccgctacgcctactactacagcggcctgggcgccggcgtgctggtggccgcctacatccaggtgagcttctggaccctggccgccggccgccagatccgcaagatccgccagaagttcttccacgccatcctgcgccaggagatcggctggttcgacatcaacgacaccaccgagctgaacacccgcctgaccgacgacatcagcaagatcagcgagggcatcggcgacaaggtgggcatgttcttccaggccgtggccaccttcttcgccggcttcatcgtgggcttcatccgcggctggaagctgaccctggtgatcatggccatcagccccatcctgggcctgagcgccgccgtgtgggccaagatcctgagcgccttcagcgacaaggagctggccgcctacgccaaggccggcgccgtggccgaggaggccctgggcgccatccgcaccgtgatcgccttcggcggccagaacaaggagctggagcgctaccagaagcacctggagaacgccaaggagatcggcatcaagaaggccatcagcgccaacatcagcatgggcatcgccttcctgctgatctacgccagctacgccctggccttctggtacggcagcaccctggtgatcagcaaggagtacaccatcggcaacgccatgaccgtgttcttcagcatcctgatcggcgccttcagcgtgggccaggccgccccctgcatcgacgccttcgccaacgcccgcggcgccgcctacgtgatcttcgacatcatcgacaacaaccccaagatcgacagcttcagcgagcgcggccacaagcccgacagcatcaagggcaacctggagttcaacgacgtgcacttcagctaccccagccgcgccaacgtgaagatcctgaagggcctgaacctgaaggtgcagagcggccagaccgtggccctggtgggcagcagcggctgcggcaagagcaccaccgtgcagctgatccagcgcctgtacgaccccgacgagggcaccatcaacatcgacggccaggacatccgcaacttcaacgtgaactacctgcgcgagatcatcggcgtggtgagccaggagcccgtgctgttcagcaccaccatcgccgagaacatctgctacggccgcggcaacgtgaccatggacgagatcaagaaggccgtgaaggaggccaacgcctacgagttcatcatgaagctgccccagaagttcgacaccctggtgggcgagcgcggcgcccagctgagcggcggccagaagcagcgcatcgccatcgcccgcgccctggtgcgcaaccccaagatcctgctgctggacgaggccaccagcgccctggacaccgagagcgaggccgaggtgcaggccgccctggacaaggcccgcgagggccgcaccaccatcgtgatcgcccaccgcctgagcaccgtgcgcaacgccgacgtgatcgccggcttcgaggacggcgtgatcgtggagcagggcagccacagcgagctgatgaagaaggagggcgtgtacttcaagctggtgaacatgcagaccagcggcagccagatccagagcgaggagttcgagctgaacgacgagaaggccgccacccgcatggcccccaacggctggaagagccgcctgttccgccacagcacccagaagaacctgaagaacagccagatgtgccagaagagcctggacgtggagaccgacggcctggaggccaacgtgccccccgtgagcttcctgaaggtgctgaagctgaacaagaccgagtggccctacttcgtggtgggcaccgtgtgcgccatcgccaacggcggcctgcagcccgccttcagcgtgatcttcagcgagatcatcgccatcttcggccccggcgacgacgccgtgaagcagcagaagtgcaacatcttcagcctgatcttcctgttcctgggcatcatcagcttcttcaccttcttcctgcagggcttcaccttcggcaaggccggcgagatcctgacccgccgcctgcgcagcatggccttcaaggccatgctgcgccaggacatgagctggttcgacgaccacaagaacagcaccggcgccctgagcacccgcctggccaccgacgccgcccaggtgcagggcgccaccggcacccgcctggccctgatcgcccagaacatcgccaacctgggcaccggcatcatcatcagcttcatctacggctggcagctgaccctgctgctgctggccgtggtgcccatcatcgccgtgagcggcatcgtggagatgaagctgctggccggcaacgccaagcgcgacaagaaggagctggaggccgccggcaagatcgccaccgaggccatcgagaacatccgcaccgtggtgagcctgacccaggagcgcaagttcgagagcatgtacgtggagaagctgtacggcccctaccgcgtgttcagcgccatcgtgttcggcgccgtggccctgggccacgccagcagcttcgcccccgactacgccaaggccaagctgagcgccgcccacctgttcatgctgttcgagcgccagcccctgatcgacagctacagcgaggagggcctgaagcccgacaagttcgagggcaacatcaccttcaacgaggtggtgttcaactaccccacccgcgccaacgtgcccgtgctgcagggcctgagcctggaggtgaagaagggccagaccctggccctggtgggcagcagcggctgcggcaagagcaccgtggtgcagctgctggagcgcttctacgaccccctggccggcaccgtgctgctggacggccaggaggccaagaagctgaacgtgcagtggctgcgcgcccagctgggcatcgtgagccaggagcccatcctgttcgactgcagcatcgccgagaacatcgcctacggcgacaacagccgcgtggtgagccaggacgagatcgtgagcgccgccaaggccgccaacatccaccccttcatcgagaccctgccccacaagtacgagacccgcgtgggcgacaagggcacccagctgagcggcggccagaagcagcgcatcgccatcgcccgcgccctgatccgccagccccagatcctgctgctggacgaggccaccagcgccctggacaccgagagcgagaaggtggtgcaggaggccctggacaaggcccgcgagggccgcacctgcatcgtgatcgcccaccgcctgagcaccatccagaacgccgacctgatcgtggtgttccagaacggccgcgtgaaggagcacggcacccaccagcagctgctggcccagaagggcatctacttcagcatggtgagcgtgcaggccggcacccagaacctg

SEQ ID NO: 1411 - DNA, 3837 bp, Artificial Sequence
  Description of Artificial Sequence: Synthetic coding sequence
atggacctggaggccgccaagaacggcaccgcctggcgccccaccagcgccgagggcgacttcgagctgggcatcagcagcaagcagaagcgcaagaagaccaagaccgtgaagatgatcggcgtgctgaccctgttccgctacagcgactggcaggacaagctgttcatgagcctgggcaccatcatggccatcgcccacggcagcggcctgcccctgatgatgatcgtgttcggcgagatgaccgacaagttcgtggacaccgccggcaacttcagcttccccgtgaacttcagcctgagcctgctgaaccccggcaagatcctggaggaggagatgacccgctacgcctactactacagcggcctgggcgccggcgtgctggtggccgcctacatccaggtgagcttctggaccctggccgccggccgccagatccgcaagatccgccagaagttcttccacgccatcctgcgccaggagatcggctggttcgacatcaacgacaccaccgagctgaacacccgcctgaccgacgacatcagcaagatcagcgagggcatcggcgacaaggtgggcatgttcttccaggccgtggccaccttcttcgccggcttcatcgtgggcttcatccgcggctggaagctgaccctggtgatcatggccatcagccccatcctgggcctgagcgccgccgtgtgggccaagatcctgagcgccttcagcgacaaggagctggccgcctacgccaaggccggcgccgtggccgaggaggccctgggcgccatccgcaccgtgatcgccttcggcggccagaacaaggagctggagcgctaccagaagcacctggagaacgccaaggagatcggcatcaagaaggccatcagcgccaacatcagcatgggcatcgccttcctgctgatctacgccagctacgccctggccttctggtacggcagcaccctggtgatcagcaaggagtacaccatcggcaacgccatgaccgtgttcttcagcatcctgatcggcgccttcagcgtgggccaggccgccccctgcatcgacgccttcgccaacgcccgcggcgccgcctacgtgatcttcgacatcatcgacaacaaccccaagatcgacagcttcagcgagcgcggccacaagcccgacagcatcaagggcaacctggagttcaacgacgtgcacttcagctaccccagccgcgccaacgtgaagatcctgaagggcctgaacctgaaggtgcagagcggccagaccgtggccctggtgggcagcagcggctgcggcaagagcaccaccgtgcagctgatccagcgcctgtacgaccccgacgagggcaccatcaacatcgacggccaggacatccgcaacttcaacgtgaactacctgcgcgagatcatcggcgtggtgagccaggagcccgtgctgttcagcaccaccatcgccgagaacatctgctacggccgcggcaacgtgaccatggacgagatcaagaaggccgtgaaggaggccaacgcctacgagttcatcatgaagctgccccagaagttcgacaccctggtgggcgagcgcggcgcccagctgagcggcggccagaagcagcgcatcgccatcgcccgcgccctggtgcgcaaccccaagatcctgctgctggacgaggccaccagcgccctggacaccgagagcgaggccgaggtgcaggccgccctggacaaggcccgcgagggccgcaccaccatcgtgatcgcccaccgcctgagcaccgtgcgcaacgccgacgtgatcgccggcttcgaggacggcgtgatcgtggagcagggcagccacagcgagctgatgaagaaggagggcgtgtacttcaagctggtgaacatgcagaccagcggcagccagatccagagcgaggagttcgagctgaacgacgagaaggccgccacccgcatggcccccaacggctggaagagccgcctgttccgccacagcacccagaagaacctgaagaacagccagatgtgccagaagagcctggacgtggagaccgacggcctggaggccaacgtgccccccgtgagcttcctgaaggtgctgaagctgaacaagaccgagtggccctacttcgtggtgggcaccgtgtgcgccatcgccaacggcggcctgcagcccgccttcagcgtgatcttcagcgagatcatcgccatcttcggccccggcgacgacgccgtgaagcagcagaagtgcaacatcttcagcctgatcttcctgttcctgggcatcatcagcttcttcaccttcttcctgcagggcttcaccttcggcaaggccggcgagatcctgacccgccgcctgcgcagcatggccttcaaggccatgctgcgccaggacatgagctggttcgacgaccacaagaacagcaccggcgccctgagcacccgcctggccaccgacgccgcccaggtgcagggcgccaccggcacccgcctggccctgatcgcccagaacatcgccaacctgggcaccggcatcatcatcagcttcatctacggctggcagctgaccctgctgctgctggccgtggtgcccatcatcgccgtgagcggcatcgtggagatgaagctgctggccggcaacgccaagcgcgacaagaaggagctggaggccgccggcaagatcgccaccgaggccatcgagaacatccgcaccgtggtgagcctgacccaggagcgcaagttcgagagcatgtacgtggagaagctgtacggcccctaccgcaacagcgtgcagaaggcccacatctacggcatcaccttcagcatcagccaggccttcatgtacttcagctacgccggctgcttccgcttcggcgcctacctgatcgtgaacggccacatgcgcttccgcgacgtgatcctggtgttcagcgccatcgtgttcggcgccgtggccctgggccacgccagcagcttcgcccccgactacgccaaggccaagctgagcgccgcccacctgttcatgctgttcgagcgccagcccctgatcgacagctacagcgaggagggcctgaagcccgacaagttcgagggcaacatcaccttcaacgaggtggtgttcaactaccccacccgcgccaacgtgcccgtgctgcagggcctgagcctggaggtgaagaagggccagaccctggccctggtgggcagcagcggctgcggcaagagcaccgtggtgcagctgctggagcgcttctacgaccccctggccggcaccgtgctgctggacggccaggaggccaagaagctgaacgtgcagtggctgcgcgcccagctgggcatcgtgagccaggagcccatcctgttcgactgcagcatcgccgagaacatcgcctacggcgacaacagccgcgtggtgagccaggacgagatcgtgagcgccgccaaggccgccaacatccaccccttcatcgagaccctgccccacaagtacgagacccgcgtgggcgacaagggcacccagctgagcggcggccagaagcagcgcatcgccatcgcccgcgccctgatccgccagccccagatcctgctgctggacgaggccaccagcgccctggacaccgagagcgagaaggtggtgcaggaggccctggacaaggcccgcgagggccgcacctgcatcgtgatcgcccaccgcctgagcaccatccagaacgccgacctgatcgtggtgttccagaacggccgcgtgaaggagcacggcacccaccagcagctgctggcccagaagggcatctacttcagcatggtgagcgtgcaggccggcacccagaacctg

SEQ ID NO: 1412 - DNA, 183 bp, Artificial Sequence
  Description of Artificial Sequence: Synthetic coding sequence
atggacctggaggccgccaagaacggcaccgcctggcgccccaccagcgccgagggcgacttcgagctgggcatcagcagcaagcagaagcgcaagaagaccaagaccgtgaagatgatcggcgtgctgaccctgttccgctacagcgactggcaggacaagctgttcatgagcctgggcacc

SEQ ID NO: 1413 - DNA, 1446 bp, Artificial Sequence
  Description of Artificial Sequence: Synthetic coding sequence
atggacgagggcatcccccacctgcaggagcgccagctgctggagcaccgcgacttcatcggcctggactacagcagcctgtacatgtgcaagcccaagcgcagcatgaagcgcgacgacaccaaggacacctacaagctgccccaccgcctgatcgagaagaagcgccgcgaccgcatcaacgagtgcatcgcccagctgaaggacctgctgcccgagcacctgaagctgaccaccctgggccacctggagaaggccgtggtgctggagctgaccctgaagcacctgaaggccctgaccgccctgaccgagcagcagcaccagaagatcatcgccctgcagaacggcgagcgcagcctgaagagccccatccagagcgacctggacgccttccacagcggcttccagacctgcgccaaggaggtgctgcagtacctgagccgcttcgagagctggaccccccgcgagccccgctgcgtgcagctgatcaaccacctgcacgccgtggccacccagttcctgcccaccccccagctgctgacccagcaggtgcccctgagcaagggcaccggcgcccccagcgccgccggcagcgccgccgccccctgcctggagcgcgccggccagaagctggagcccctggcctactgcgtgcccgtgatccagcgcacccagcccagcgccgagctggccgccgagaacgacaccgacaccgacagcggctacggcggcgaggccgaggcccgccccgaccgcgagaagggcaagggcgccggcgccagccgcgtgaccatcaagcaggagccccccggcgaggacagccccgcccccaagcgcatgaagctggacagccgcggcggcggcagcggcggcggccccggcggcggcgccgccgccgccgccgccgccctgctgggccccgaccccgccgccgccgccgccctgctgcgccccgacgccgccctgctgagcagcctggtggccttcggcggcggcggcggcgcccccttcccccagcccgccgccgccgccgcccccttctgcctgcccttctgcttcctgagccccagcgccgccgccgcctacgtgcagcccttcctggacaagagcggcctggagaagtacctgtaccccgccgccgccgccgcccccttccccctgctgtaccccggcatccccgcccccgccgccgccgccgccgccgccgccgccgccgccgccgccgccgccgccttcccctgcctgagcagcgtgctgagccccccccccgagaaggccggcgccgccgccgccaccctgctgccccacgaggtggcccccctgggcgccccccacccccagcacccccacggccgcacccacctgcccttcgccggcccccgcgagcccggcaaccccgagagcagcgcccaggaggaccccagccagcccggcaaggaggccccc

SEQ ID NO: 1414 - DNA, 1188 bp, Artificial Sequence
  Description of Artificial Sequence: Synthetic coding sequence
atggtggccggcacccgctgcctgctggccctgctgctgccccaggtgctgctgggcggcgccgccggcctggtgcccgagctgggccgccgcaagttcgccgccgccagcagcggccgccccagcagccagcccagcgacgaggtgctgagcgagttcgagctgcgcctgctgagcatgttcggcctgaagcagcgccccacccccagccgcgacgccgtggtgcccccctacatgctggacctgtaccgccgccacagcggccagcccggcagccccgcccccgaccaccgcctggagcgcgccgccagccgcgccaacaccgtgcgcagcttccaccacgaggagagcctggaggagctgcccgagaccagcggcaagaccacccgccgcttcttcttcaacctgagcagcatccccaccgaggagttcatcaccagcgccgagctgcaggtgttccgcgagcagatgcaggacgccctgggcaacaacagcagcttccaccaccgcatcaacatctacgagatcatcaagcccgccaccgccaacagcaagttccccgtgacccgcctgctggacacccgcctggtgaaccagaacgccagccgctgggagagcttcgacgtgacccccgccgtgatgcgctggaccgcccagggccacgccaaccacggcttcgtggtggaggtggcccacctggaggagaagcagggcgtgagcaagcgccacgtgcgcatcagccgcagcctgcaccaggacgagcacagctggagccagatccgccccctgctggtgaccttcggccacgacggcaagggccaccccctgcacaagcgcgagaagcgccaggccaagcacaagcagcgcaagcgcctgaagagcagctgcaagcgccaccccctgtacgtggacttcagcgacgtgggctggaacgactggatcgtggccccccccggctaccacgccttctactgccacggcgagtgccccttccccctggccgaccacctgaacagcaccaaccacgccatcgtgcagaccctggtgaacagcgtgaacagcaagatccccaaggcctgctgcgtgcccaccgagctgagcgccatcagcatgctgtacctggacgagaacgagaaggtggtgctgaagaactaccaggacatggtggtggagggctgcggctgccgc

SEQ ID NO: 1415 - DNA, 1293 bp, Artificial Sequence
  Description of Artificial Sequence: Synthetic coding sequence
atgcacgtgcgcagcctgcgcgccgccgccccccacagcttcgtggccctgtgggcccccctgttcctgctgcgcagcgccctggccgacttcagcctggacaacgaggtgcacagcagcttcatccaccgccgcctgcgcagccaggagcgccgcgagatgcagcgcgagatcctgagcatcctgggcctgccccaccgcccccgcccccacctgcagggcaagcacaacagcgcccccatgttcatgctggacctgtacaacgccatggccgtggaggagggcggcggccccggcggccagggcttcagctacccctacaaggccgtgttcagcacccagggcccccccctggccagcctgcaggacagccacttcctgaccgacgccgacatggtgatgagcttcgtgaacctggtggagcacgacaaggagttcttccacccccgctaccaccaccgcgagttccgcttcgacctgagcaagatccccgagggcgaggccgtgaccgccgccgagttccgcatctacaaggactacatccgcgagcgcttcgacaacgagaccttccgcatcagcgtgtaccaggtgctgcaggagcacctgggccgcgagagcgacctgttcctgctggacagccgcaccctgtgggccagcgaggagggctggctggtgttcgacatcaccgccaccagcaaccactgggtggtgaacccccgccacaacctgggcctgcagctgagcgtggagaccctggacggccagagcatcaaccccaagctggccggcctgatcggccgccacggcccccagaacaagcagcccttcatggtggccttcttcaaggccaccgaggtgcacttccgcagcatccgcagcaccggcagcaagcagcgcagccagaaccgcagcaagacccccaagaaccaggaggccctgcgcatggccaacgtggccgagaacagcagcagcgaccagcgccaggcctgcaagaagcacgagctgtacgtgagcttccgcgacctgggctggcaggactggatcatcgcccccgagggctacgccgcctactactgcgagggcgagtgcgccttccccctgaacagctacatgaacgccaccaaccacgccatcgtgcagaccctggtgcacttcatcaaccccgagaccgtgcccaagccctgctgcgcccccacccagctgaacgccatcagcgtgctgtacttcgacgacagcagcaacgtgatcctgaagaagtaccgcaacatggtggtgcgcgcctgcggctgccac

SEQ ID NO: 1416 - DNA, 1095 bp, Artificial Sequence
  Description of Artificial Sequence: Synthetic coding sequence
atgcacgtgcgcagcctgcgcgccgccgccccccacagcttcgtggccctgtgggcccccctgttcctgctgcgcagcgccctggccgacttcagcctggacaacgaggtgcacagcagcttcatccaccgccgcctgcgcagccaggagcgccgcgagatgcagcgcgagatcctgagcatcctgggcctgccccaccgcccccgcccccacctgcagggcaagcacaacagcgcccccatgttcatgctggacctgtacaacgccatggccgtggaggagggcggcggccccggcggccagggcttcagctacccctacaaggccgtgttcagcacccagggcccccccctggccagcctgcaggacagccacttcctgaccgacgccgacatggtgatgagcttcgtgaacctggtggagcacgacaaggagttcttccacccccgctaccaccaccgcgagttccgcttcgacctgagcaagatccccgagggcgaggccgtgaccgccgccgagttccgcatctacaaggactacatccgcgagcgcttcgacaacgagaccttccgcatcagcgtgtaccaggtgctgcaggagcacctgggccgcgagagcgacctgttcctgctggacagccgcaccctgtgggccagcgaggagggctggctggtgttcgacatcaccgccaccagcaaccactgggtggtgaacccccgccacaacctgggcctgcagctgagcgtggagaccctggacgagaacagcagcagcgaccagcgccaggcctgcaagaagcacgagctgtacgtgagcttccgcgacctgggctggcaggactggatcatcgcccccgagggctacgccgcctactactgcgagggcgagtgcgccttccccctgaacagctacatgaacgccaccaaccacgccatcgtgcagaccctggtgcacttcatcaaccccgagaccgtgcccaagccctgctgcgcccccacccagctgaacgccatcagcgtgctgtacttcgacgacagcagcaacgtgatcctgaagaagtaccgcaacatggtggtgcgcgcctgcggctgccac

SEQ ID NO: 1417 - DNA, 4500 bp, Artificial Sequence
  Description of Artificial Sequence: Synthetic coding sequence
atgacccgcatcctgaccgccttcaaggtggtgcgcaccctgaagaccggcttcggcttcaccaacgtgaccgcccaccagaagtggaagttcagccgccccggcatccgcctgctgagcgtgaaggcccagaccgcccacatcgtgctggaggacggcaccaagatgaagggctacagcttcggccaccccagcagcgtggccggcgaggtggtgttcaacaccggcctgggcggctaccccgaggccatcaccgaccccgcctacaagggccagatcctgaccatggccaaccccatcatcggcaacggcggcgcccccgacaccaccgccctggacgagctgggcctgagcaagtacctggagagcaacggcatcaaggtgagcggcctgctggtgctggactacagcaaggactacaaccactggctggccaccaagagcctgggccagtggctgcaggaggagaaggtgcccgccatctacggcgtggacacccgcatgctgaccaagatcatccgcgacaagggcaccatgctgggcaagatcgagttcgagggccagcccgtggacttcgtggaccccaacaagcagaacctgatcgccgaggtgagcaccaaggacgtgaaggtgtacggcaagggcaaccccaccaaggtggtggccgtggactgcggcatcaagaacaacgtgatccgcctgctggtgaagcgcggcgccgaggtgcacctggtgccctggaaccacgacttcaccaagatggagtacgacggcatcctgatcgccggcggccccggcaaccccgccctggccgagcccctgatccagaacgtgcgcaagatcctggagagcgaccgcaaggagcccctgttcggcatcagcaccggcaacctgatcaccggcctggccgccggcgccaagacctacaagatgagcatggccaaccgcggccagaaccagcccgtgctgaacatcaccaacaagcaggccttcatcaccgcccagaaccacggctacgccctggacaacaccctgcccgccggctggaagcccctgttcgtgaacgtgaacgaccagaccaacgagggcatcatgcacgagagcaagcccttcttcgccgtgcagttccaccccgaggtgacccccggccccatcgacaccgagtacctgttcgacagcttcttcagcctgatcaagaagggcaaggccaccaccatcaccagcgtgctgcccaagcccgccctggtggccagccgcgtggaggtgagcaaggtgctgatcctgggcagcggcggcctgagcatcggccaggccggcgagttcgactacagcggcagccaggccgtgaaggccatgaaggaggagaacgtgaagaccgtgctgatgaaccccaacatcgccagcgtgcagaccaacgaggtgggcctgaagcaggccgacaccgtgtacttcctgcccatcaccccccagttcgtgaccgaggtgatcaaggccgagcagcccgacggcctgatcctgggcatgggcggccagaccgccctgaactgcggcgtggagctgttcaagcgcggcgtgctgaaggagtacggcgtgaaggtgctgggcaccagcgtggagagcatcatggccaccgaggaccgccagctgttcagcgacaagctgaacgagatcaacgagaagatcgcccccagcttcgccgtggagagcatcgaggacgccctgaaggccgccgacaccatcggctaccccgtgatgatccgcagcgcctacgccctgggcggcctgggcagcggcatctgccccaaccgcgagaccctgatggacctgagcaccaaggccttcgccatgaccaaccagatcctggtggagaagagcgtgaccggctggaaggagatcgagtacgaggtggtgcgcgacgccgacgacaactgcgtgaccgtgtgcaacatggagaacgtggacgccatgggcgtgcacaccggcgacagcgtggtggtggcccccgcccagaccctgagcaacgccgagttccagatgctgcgccgcaccagcatcaacgtggtgcgccacctgggcatcgtgggcgagtgcaacatccagttcgccctgcaccccaccagcatggagtactgcatcatcgaggtgaacgcccgcctgagccgcagcagcgccctggccagcaaggccaccggctaccccctggccttcatcgccgccaagatcgccctgggcatccccctgcccgagatcaagaacgtggtgagcggcaagaccagcgcctgcttcgagcccagcctggactacatggtgaccaagatcccccgctgggacctggaccgcttccacggcaccagcagccgcatcggcagcagcatgaagagcgtgggcgaggtgatggccatcggccgcaccttcgaggagagcttccagaaggccctgcgcatgtgccaccccagcatcgagggcttcaccccccgcctgcccatgaacaaggagtggcccagcaacctggacctgcgcaaggagctgagcgagcccagcagcacccgcatctacgccatcgccaaggccatcgacgacaacatgagcctggacgagatcgagaagctgacctacatcgacaagtggttcctgtacaagatgcgcgacatcctgaacatggagaagaccctgaagggcctgaacagcgagagcatgaccgaggagaccctgaagcgcgccaaggagatcggcttcagcgacaagcagatcagcaagtgcctgggcctgaccgaggcccagacccgcgagctgcgcctgaagaagaacatccacccctgggtgaagcagatcgacaccctggccgccgagtaccccagcgtgaccaactacctgtacgtgacctacaacggccaggagcacgacgtgaacttcgacgaccacggcatgatggtgctgggctgcggcccctaccacatcggcagcagcgtggagttcgactggtgcgccgtgagcagcatccgcaccctgcgccagctgggcaagaagaccgtggtggtgaactgcaaccccgagaccgtgagcaccgacttcgacgagtgcgacaagctgtacttcgaggagctgagcctggagcgcatcctggacatctaccaccaggaggcctgcggcggctgcatcatcagcgtgggcggccagatccccaacaacctggccgtgcccctgtacaagaacggcgtgaagatcatgggcaccagccccctgcagatcgaccgcgccgaggaccgcagcatcttcagcgccgtgctggacgagctgaaggtggcccaggccccctggaaggccgtgaacaccctgaacgaggccctggagttcgccaagagcgtggactacccctgcctgctgcgccccagctacgtgctgagcggcagcgccatgaacgtggtgttcagcgaggacgagatgaagaagttcctggaggaggccacccgcgtgagccaggagcaccccgtggtgctgaccaagttcgtggagggcgcccgcgaggtggagatggacgccgtgggcaaggacggccgcgtgatcagccacgccatcagcgagcacgtggaggacgccggcgtgcacagcggcgacgccaccctgatgctgcccacccagaccatcagccagggcgccatcgagaaggtgaaggacgccacccgcaagatcgccaaggccttcgccatcagcggccccttcaacgtgcagttcctggtgaagggcaacgacgtgctggtgatcgagtgcaacctgcgcgccagccgcagcttccccttcgtgagcaagaccctgggcgtggacttcatcgacgtggccaccaaggtgatgatcggcgagaacgtggacgagaagcacctgcccaccctggaccaccccatcatccccgccgactacgtggccatcaaggcccccatgttcagctggccccgcctgcgcgacgccgaccccatcctgcgctgcgagatggccagcaccggcgaggtggcctgcttcggcgagggcatccacaccgccttcctgaaggccatgctgagcaccggcttcaagatcccccagaagggcatcctgatcggcatccagcagagcttccgcccccgcttcctgggcgtggccgagcagctgcacaacgagggcttcaagctgttcgccaccgaggccaccagcgactggctgaacgccaacaacgtgcccgccacccccgtggcctggcccagccaggagggccagaaccccagcctgagcagcatccgcaagctgatccgcgacggcagcatcgacctggtgatcaacctgcccaacaacaacaccaagttcgtgcacgacaactacgtgatccgccgcaccgccgtggacagcggcatccccctgctgaccaacttccaggtgaccaagctgttcgccgaggccgtgcagaagagccgcaaggtggacagcaagagcctgttccactaccgccagtacagcgccggcaaggccgcc

SEQ ID NO: 1418 - DNA, 363 bp, Artificial Sequence
  Description of Artificial Sequence: Synthetic coding sequence
atgacccgcatcctgaccgccttcaaggtggtgcgcaccctgaagaccggcttcggcttcaccaacgtgaccgcccaccagaagtggaagttcagccgccccggcatccgcctgctgagcgtgaaggcccagaccgcccacatcgtgctggaggacggcaccaagatgaagggctacagcttcggccaccccagcagcgtggccggcgaggtggtgttcaacaccggcctgggcggctaccccgaggccatcaccgaccccgcctacaagggccagatcctgaccatggccaaccccatcatcggcaacggcggcgcccccgacaccaccgccctggacgagctgggcctgagcaagtacctg

SEQ ID NO: 1419 - DNA, 4518 bp, Artificial Sequence
  Description of Artificial Sequence: Synthetic coding sequence
atgccccagatcatcaagatgacccgcatcctgaccgccttcaaggtggtgcgcaccctgaagaccggcttcggcttcaccaacgtgaccgcccaccagaagtggaagttcagccgccccggcatccgcctgctgagcgtgaaggcccagaccgcccacatcgtgctggaggacggcaccaagatgaagggctacagcttcggccaccccagcagcgtggccggcgaggtggtgttcaacaccggcctgggcggctaccccgaggccatcaccgaccccgcctacaagggccagatcctgaccatggccaaccccatcatcggcaacggcggcgcccccgacaccaccgccctggacgagctgggcctgagcaagtacctggagagcaacggcatcaaggtgagcggcctgctggtgctggactacagcaaggactacaaccactggctggccaccaagagcctgggccagtggctgcaggaggagaaggtgcccgccatctacggcgtggacacccgcatgctgaccaagatcatccgcgacaagggcaccatgctgggcaagatcgagttcgagggccagcccgtggacttcgtggaccccaacaagcagaacctgatcgccgaggtgagcaccaaggacgtgaaggtgtacggcaagggcaaccccaccaaggtggtggccgtggactgcggcatcaagaacaacgtgatccgcctgctggtgaagcgcggcgccgaggtgcacctggtgccctggaaccacgacttcaccaagatggagtacgacggcatcctgatcgccggcggccccggcaaccccgccctggccgagcccctgatccagaacgtgcgcaagatcctggagagcgaccgcaaggagcccctgttcggcatcagcaccggcaacctgatcaccggcctggccgccggcgccaagacctacaagatgagcatggccaaccgcggccagaaccagcccgtgctgaacatcaccaacaagcaggccttcatcaccgcccagaaccacggctacgccctggacaacaccctgcccgccggctggaagcccctgttcgtgaacgtgaacgaccagaccaacgagggcatcatgcacgagagcaagcccttcttcgccgtgcagttccaccccgaggtgacccccggccccatcgacaccgagtacctgttcgacagcttcttcagcctgatcaagaagggcaaggccaccaccatcaccagcgtgctgcccaagcccgccctggtggccagccgcgtggaggtgagcaaggtgctgatcctgggcagcggcggcctgagcatcggccaggccggcgagttcgactacagcggcagccaggccgtgaaggccatgaaggaggagaacgtgaagaccgtgctgatgaaccccaacatcgccagcgtgcagaccaacgaggtgggcctgaagcaggccgacaccgtgtacttcctgcccatcaccccccagttcgtgaccgaggtgatcaaggccgagcagcccgacggcctgatcctgggcatgggcggccagaccgccctgaactgcggcgtggagctgttcaagcgcggcgtgctgaaggagtacggcgtgaaggtgctgggcaccagcgtggagagcatcatggccaccgaggaccgccagctgttcagcgacaagctgaacgagatcaacgagaagatcgcccccagcttcgccgtggagagcatcgaggacgccctgaaggccgccgacaccatcggctaccccgtgatgatccgcagcgcctacgccctgggcggcctgggcagcggcatctgccccaaccgcgagaccctgatggacctgagcaccaaggccttcgccatgaccaaccagatcctggtggagaagagcgtgaccggctggaaggagatcgagtacgaggtggtgcgcgacgccgacgacaactgcgtgaccgtgtgcaacatggagaacgtggacgccatgggcgtgcacaccggcgacagcgtggtggtggcccccgcccagaccctgagcaacgccgagttccagatgctgcgccgcaccagcatcaacgtggtgcgccacctgggcatcgtgggcgagtgcaacatccagttcgccctgcaccccaccagcatggagtactgcatcatcgaggtgaacgcccgcctgagccgcagcagcgccctggccagcaaggccaccggctaccccctggccttcatcgccgccaagatcgccctgggcatccccctgcccgagatcaagaacgtggtgagcggcaagaccagcgcctgcttcgagcccagcctggactacatggtgaccaagatcccccgctgggacctggaccgcttccacggcaccagcagccgcatcggcagcagcatgaagagcgtgggcgaggtgatggccatcggccgcaccttcgaggagagcttccagaaggccctgcgcatgtgccaccccagcatcgagggcttcaccccccgcctgcccatgaacaaggagtggcccagcaacctggacctgcgcaaggagctgagcgagcccagcagcacccgcatctacgccatcgccaaggccatcgacgacaacatgagcctggacgagatcgagaagctgacctacatcgacaagtggttcctgtacaagatgcgcgacatcctgaacatggagaagaccctgaagggcctgaacagcgagagcatgaccgaggagaccctgaagcgcgccaaggagatcggcttcagcgacaagcagatcagcaagtgcctgggcctgaccgaggcccagacccgcgagctgcgcctgaagaagaacatccacccctgggtgaagcagatcgacaccctggccgccgagtaccccagcgtgaccaactacctgtacgtgacctacaacggccaggagcacgacgtgaacttcgacgaccacggcatgatggtgctgggctgcggcccctaccacatcggcagcagcgtggagttcgactggtgcgccgtgagcagcatccgcaccctgcgccagctgggcaagaagaccgtggtggtgaactgcaaccccgagaccgtgagcaccgacttcgacgagtgcgacaagctgtacttcgaggagctgagcctggagcgcatcctggacatctaccaccaggaggcctgcggcggctgcatcatcagcgtgggcggccagatccccaacaacctggccgtgcccctgtacaagaacggcgtgaagatcatgggcaccagccccctgcagatcgaccgcgccgaggaccgcagcatcttcagcgccgtgctggacgagctgaaggtggcccaggccccctggaaggccgtgaacaccctgaacgaggccctggagttcgccaagagcgtggactacccctgcctgctgcgccccagctacgtgctgagcggcagcgccatgaacgtggtgttcagcgaggacgagatgaagaagttcctggaggaggccacccgcgtgagccaggagcaccccgtggtgctgaccaagttcgtggagggcgcccgcgaggtggagatggacgccgtgggcaaggacggccgcgtgatcagccacgccatcagcgagcacgtggaggacgccggcgtgcacagcggcgacgccaccctgatgctgcccacccagaccatcagccagggcgccatcgagaaggtgaaggacgccacccgcaagatcgccaaggccttcgccatcagcggccccttcaacgtgcagttcctggtgaagggcaacgacgtgctggtgatcgagtgcaacctgcgcgccagccgcagcttccccttcgtgagcaagaccctgggcgtggacttcatcgacgtggccaccaaggtgatgatcggcgagaacgtggacgagaagcacctgcccaccctggaccaccccatcatccccgccgactacgtggccatcaaggcccccatgttcagctggccccgcctgcgcgacgccgaccccatcctgcgctgcgagatggccagcaccggcgaggtggcctgcttcggcgagggcatccacaccgccttcctgaaggccatgctgagcaccggcttcaagatcccccagaagggcatcctgatcggcatccagcagagcttccgcccccgcttcctgggcgtggccgagcagctgcacaacgagggcttcaagctgttcgccaccgaggccaccagcgactggctgaacgccaacaacgtgcccgccacccccgtggcctggcccagccaggagggccagaaccccagcctgagcagcatccgcaagctgatccgcgacggcagcatcgacctggtgatcaacctgcccaacaacaacaccaagttcgtgcacgacaactacgtgatccgccgcaccgccgtggacagcggcatccccctgctgaccaacttccaggtgaccaagctgttcgccgaggccgtgcagaagagccgcaaggtggacagcaagagcctgttccactaccgccagtacagcgccggcaaggccgcc

SEQ ID NO: 1420 - DNA, 3147 bp, Artificial Sequence
  Description of Artificial Sequence: Synthetic coding sequence
atgaaggaggagaacgtgaagaccgtgctgatgaaccccaacatcgccagcgtgcagaccaacgaggtgggcctgaagcaggccgacaccgtgtacttcctgcccatcaccccccagttcgtgaccgaggtgatcaaggccgagcagcccgacggcctgatcctgggcatgggcggccagaccgccctgaactgcggcgtggagctgttcaagcgcggcgtgctgaaggagtacggcgtgaaggtgctgggcaccagcgtggagagcatcatggccaccgaggaccgccagctgttcagcgacaagctgaacgagatcaacgagaagatcgcccccagcttcgccgtggagagcatcgaggacgccctgaaggccgccgacaccatcggctaccccgtgatgatccgcagcgcctacgccctgggcggcctgggcagcggcatctgccccaaccgcgagaccctgatggacctgagcaccaaggccttcgccatgaccaaccagatcctggtggagaagagcgtgaccggctggaaggagatcgagtacgaggtggtgcgcgacgccgacgacaactgcgtgaccgtgtgcaacatggagaacgtggacgccatgggcgtgcacaccggcgacagcgtggtggtggcccccgcccagaccctgagcaacgccgagttccagatgctgcgccgcaccagcatcaacgtggtgcgccacctgggcatcgtgggcgagtgcaacatccagttcgccctgcaccccaccagcatggagtactgcatcatcgaggtgaacgcccgcctgagccgcagcagcgccctggccagcaaggccaccggctaccccctggccttcatcgccgccaagatcgccctgggcatccccctgcccgagatcaagaacgtggtgagcggcaagaccagcgcctgcttcgagcccagcctggactacatggtgaccaagatcccccgctgggacctggaccgcttccacggcaccagcagccgcatcggcagcagcatgaagagcgtgggcgaggtgatggccatcggccgcaccttcgaggagagcttccagaaggccctgcgcatgtgccaccccagcatcgagggcttcaccccccgcctgcccatgaacaaggagtggcccagcaacctggacctgcgcaaggagctgagcgagcccagcagcacccgcatctacgccatcgccaaggccatcgacgacaacatgagcctggacgagatcgagaagctgacctacatcgacaagtggttcctgtacaagatgcgcgacatcctgaacatggagaagaccctgaagggcctgaacagcgagagcatgaccgaggagaccctgaagcgcgccaaggagatcggcttcagcgacaagcagatcagcaagtgcctgggcctgaccgaggcccagacccgcgagctgcgcctgaagaagaacatccacccctgggtgaagcagatcgacaccctggccgccgagtaccccagcgtgaccaactacctgtacgtgacctacaacggccaggagcacgacgtgaacttcgacgaccacggcatgatggtgctgggctgcggcccctaccacatcggcagcagcgtggagttcgactggtgcgccgtgagcagcatccgcaccctgcgccagctgggcaagaagaccgtggtggtgaactgcaaccccgagaccgtgagcaccgacttcgacgagtgcgacaagctgtacttcgaggagctgagcctggagcgcatcctggacatctaccaccaggaggcctgcggcggctgcatcatcagcgtgggcggccagatccccaacaacctggccgtgcccctgtacaagaacggcgtgaagatcatgggcaccagccccctgcagatcgaccgcgccgaggaccgcagcatcttcagcgccgtgctggacgagctgaaggtggcccaggccccctggaaggccgtgaacaccctgaacgaggccctggagttcgccaagagcgtggactacccctgcctgctgcgccccagctacgtgctgagcggcagcgccatgaacgtggtgttcagcgaggacgagatgaagaagttcctggaggaggccacccgcgtgagccaggagcaccccgtggtgctgaccaagttcgtggagggcgcccgcgaggtggagatggacgccgtgggcaaggacggccgcgtgatcagccacgccatcagcgagcacgtggaggacgccggcgtgcacagcggcgacgccaccctgatgctgcccacccagaccatcagccagggcgccatcgagaaggtgaaggacgccacccgcaagatcgccaaggccttcgccatcagcggccccttcaacgtgcagttcctggtgaagggcaacgacgtgctggtgatcgagtgcaacctgcgcgccagccgcagcttccccttcgtgagcaagaccctgggcgtggacttcatcgacgtggccaccaaggtgatgatcggcgagaacgtggacgagaagcacctgcccaccctggaccaccccatcatccccgccgactacgtggccatcaaggcccccatgttcagctggccccgcctgcgcgacgccgaccccatcctgcgctgcgagatggccagcaccggcgaggtggcctgcttcggcgagggcatccacaccgccttcctgaaggccatgctgagcaccggcttcaagatcccccagaagggcatcctgatcggcatccagcagagcttccgcccccgcttcctgggcgtggccgagcagctgcacaacgagggcttcaagctgttcgccaccgaggccaccagcgactggctgaacgccaacaacgtgcccgccacccccgtggcctggcccagccaggagggccagaaccccagcctgagcagcatccgcaagctgatccgcgacggcagcatcgacctggtgatcaacctgcccaacaacaacaccaagttcgtgcacgacaactacgtgatccgccgcaccgccgtggacagcggcatccccctgctgaccaacttccaggtgaccaagctgttcgccgaggccgtgcagaagagccgcaaggtggacagcaagagcctgttccactaccgccagtacagcgccggcaaggccgcc

SEQ ID NO: 1421 - DNA, 552 bp, Artificial Sequence
  Description of Artificial Sequence: Synthetic coding sequence
atggccgaccacctgatgctggccgagggctaccgcctggtgcagcgcccccccagcgccgccgccgcccacggcccccacgccctgcgcaccctgcccccctacgccggccccggcctggacagcggcctgcgcccccgcggcgcccccctgggccccccccccccccgccagcccggcgccctggcctacggcgccttcggcccccccagcagcttccagcccttccccgccgtgcccccccccgccgccggcatcgcccacctgcagcccgtggccaccccctaccccggccgcgccgccgccccccccaacgcccccggcggcccccccggcccccagcccgcccccagcgccgccgccccccccccccccgcccacgccctgggcggcatggacgccgagctgatcgacgaggaggccctgaccagcctggagctggagctgggcctgcaccgcgtgcgcgagctgcccgagctgttcctgggccagagcgagttcgactgcttcagcgacctgggcagcgccccccccgccggcagcgtgagctgc

SEQ ID NO: 1422 - DNA, 3195 bp, Artificial Sequence
  Description of Artificial Sequence: Synthetic coding sequence
atgaagatcctgatcctgggcatcttcctgttcctgtgcagcacccccgcctgggccaaggagaagcactactacatcggcatcatcgagaccacctgggactacgccagcgaccacggcgagaagaagctgatcagcgtggacaccgagcacagcaacatctacctgcagaacggccccgaccgcatcggccgcctgtacaagaaggccctgtacctgcagtacaccgacgagaccttccgcaccaccatcgagaagcccgtgtggctgggcttcctgggccccatcatcaaggccgagaccggcgacaaggtgtacgtgcacctgaagaacctggccagccgcccctacaccttccacagccacggcatcacctactacaaggagcacgagggcgccatctaccccgacaacaccaccgacttccagcgcgccgacgacaaggtgtaccccggcgagcagtacacctacatgctgctggccaccgaggagcagagccccggcgagggcgacggcaactgcgtgacccgcatctaccacagccacatcgacgcccccaaggacatcgccagcggcctgatcggccccctgatcatctgcaagaaggacagcctggacaaggagaaggagaagcacatcgaccgcgagttcgtggtgatgttcagcgtggtggacgagaacttcagctggtacctggaggacaacatcaagacctactgcagcgagcccgagaaggtggacaaggacaacgaggacttccaggagagcaaccgcatgtacagcgtgaacggctacaccttcggcagcctgcccggcctgagcatgtgcgccgaggaccgcgtgaagtggtacctgttcggcatgggcaacgaggtggacgtgcacgccgccttcttccacggccaggccctgaccaacaagaactaccgcatcgacaccatcaacctgttccccgccaccctgttcgacgcctacatggtggcccagaaccccggcgagtggatgctgagctgccagaacctgaaccacctgaaggccggcctgcaggccttcttccaggtgcaggagtgcaacaagagcagcagcaaggacaacatccgcggcaagcacgtgcgccactactacatcgccgccgaggagatcatctggaactacgcccccagcggcatcgacatcttcaccaaggagaacctgaccgcccccggcagcgacagcgccgtgttcttcgagcagggcaccacccgcatcggcggcagctacaagaagctggtgtaccgcgagtacaccgacgccagcttcaccaaccgcaaggagcgcggccccgaggaggagcacctgggcatcctgggccccgtgatctgggccgaggtgggcgacaccatccgcgtgaccttccacaacaagggcgcctaccccctgagcatcgagcccatcggcgtgcgcttcaacaagaacaacgagggcacctactacagccccaactacaacccccagagccgcagcgtgccccccagcgccagccacgtggcccccaccgagaccttcacctacgagtggaccgtgcccaaggaggtgggccccaccaacgccgaccccgtgtgcctggccaagatgtactacagcgccgtggagcccaccaaggacatcttcaccggcctgatcggccccatgaagatctgcaagaagggcagcctgcacgccaacggccgccagaaggacgtggacaaggagttctacctgttccccaccgtgttcgacgagaacgagagcctgctgctggaggacaacatccgcatgttcaccaccgcccccgaccaggtggacaaggaggacgaggacttccaggagagcaacaagatgcacagcatgaacggcttcatgtacggcaaccagcccggcctgaccatgtgcaagggcgacagcgtggtgtggtacctgttcagcgccggcaacgaggccgacgtgcacggcatctacttcagcggcaacacctacctgtggcgcggcgagcgccgcgacaccgccaacctgttcccccagaccagcctgaccctgcacatgtggcccgacaccgagggcaccttcaacgtggagtgcctgaccaccgaccactacaccggcggcatgaagcagaagtacaccgtgaaccagtgccgccgccagagcgaggacagcaccttctacctgggcgagcgcacctactacatcgccgccgtggaggtggagtgggactacagcccccagcgcgagtgggagaaggagctgcaccacctgcaggagcagaacgtgagcaacgccttcctggacaagggcgagttctacatcggcagcaagtacaagaaggtggtgtaccgccagtacaccgacagcaccttccgcgtgcccgtggagcgcaaggccgaggaggagcacctgggcatcctgggcccccagctgcacgccgacgtgggcgacaaggtgaagatcatcttcaagaacatggccacccgcccctacagcatccacgcccacggcgtgcagaccgagagcagcaccgtgacccccaccctgcccggcgagaccctgacctacgtgtggaagatccccgagcgcagcggcgccggcaccgaggacagcgcctgcatcccctgggcctactacagcaccgtggaccaggtgaaggacctgtacagcggcctgatcggccccctgatcgtgtgccgccgcccctacctgaaggtgttcaacccccgccgcaagctggagttcgccctgctgttcctggtgttcgacgagaacgagagctggtacctggacgacaacatcaagacctacagcgaccaccccgagaaggtgaacaaggacgacgaggagttcatcgagagcaacaagatgcacgccatcaacggccgcatgttcggcaacctgcagggcctgaccatgcacgtgggcgacgaggtgaactggtacctgatgggcatgggcaacgagatcgacctgcacaccgtgcacttccacggccacagcttccagtacaagcaccgcggcgtgtacagcagcgacgtgttcgacatcttccccggcacctaccagaccctggagatgttcccccgcacccccggcatctggctgctgcactgccacgtgaccgaccacatccacgccggcatggagaccacctacaccgtgctgcagaacgaggacaccaagagcggc

SEQ ID NO: 1423 - DNA, 1866 bp, Artificial Sequence
  Description of Artificial Sequence: Synthetic coding sequence
atggcccacgtgcgcggcctgcagctgcccggctgcctggccctggccgccctgtgcagcctggtgcacagccagcacgtgttcctggccccccagcaggcccgcagcctgctgcagcgcgtgcgccgcgccaacaccttcctggaggaggtgcgcaagggcaacctggagcgcgagtgcgtggaggagacctgcagctacgaggaggccttcgaggccctggagagcagcaccgccaccgacgtgttctgggccaagtacaccgcctgcgagaccgcccgcaccccccgcgacaagctggccgcctgcctggagggcaactgcgccgagggcctgggcaccaactaccgcggccacgtgaacatcacccgcagcggcatcgagtgccagctgtggcgcagccgctacccccacaagcccgagatcaacagcaccacccaccccggcgccgacctgcaggagaacttctgccgcaaccccgacagcagcaccaccggcccctggtgctacaccaccgaccccaccgtgcgccgccaggagtgcagcatccccgtgtgcggccaggaccaggtgaccgtggccatgaccccccgcagcgagggcagcagcgtgaacctgagcccccccctggagcagtgcgtgcccgaccgcggccagcagtaccagggccgcctggccgtgaccacccacggcctgccctgcctggcctgggccagcgcccaggccaaggccctgagcaagcaccaggacttcaacagcgccgtgcagctggtggagaacttctgccgcaaccccgacggcgacgaggagggcgtgtggtgctacgtggccggcaagcccggcgacttcggctactgcgacctgaactactgcgaggaggccgtggaggaggagaccggcgacggcctggacgaggacagcgaccgcgccatcgagggccgcaccgccaccagcgagtaccagaccttcttcaacccccgcaccttcggcagcggcgaggccgactgcggcctgcgccccctgttcgagaagaagagcctggaggacaagaccgagcgcgagctgctggagagctacatcgacggccgcatcgtggagggcagcgacgccgagatcggcatgagcccctggcaggtgatgctgttccgcaagagcccccaggagctgctgtgcggcgccagcctgatcagcgaccgctgggtgctgaccgccgcccactgcctgctgtaccccccctgggacaagaacttcaccgagaacgacctgctggtgcgcatcggcaagcacagccgcacccgctacgagcgcaacatcgagaagatcagcatgctggagaagatctacatccacccccgctacaactggcgcgagaacctggaccgcgacatcgccctgatgaagctgaagaagcccgtggccttcagcgactacatccaccccgtgtgcctgcccgaccgcgagaccgccgccagcctgctgcaggccggctacaagggccgcgtgaccggctggggcaacctgaaggagacctggaccgccaacgtgggcaagggccagcccagcgtgctgcaggtggtgaacctgcccatcgtggagcgccccgtgtgcaaggacagcacccgcatccgcatcaccgacaacatgttctgcgccggctacaagcccgacgagggcaagcgcggcgacgcctgcgagggcgacagcggcggccccttcgtgatgaagagccccttcaacaaccgctggtaccagatgggcatcgtgagctggggcgagggctgcgaccgcgacggcaagtacggcttctacacccacgtgttccgcctgaagaagtggatccagaaggtgatcgaccagttcggcgag

SEQ ID NO: 1424 - DNA, 1749 bp, Artificial Sequence
  Description of Artificial Sequence: Synthetic coding sequence
atggcccacgtgcgcggcctgcagctgcccggctgcctggccctggccgccctgtgcagcctggtgcacagccagcacgtgttcctggccccccagcaggcccgcagcctgctgcagcgcgtgcgccgcgccaacaccttcctggaggaggtgcgcaagggcaacctggagcgcgagtgcgtggaggagacctgcagctacgaggaggccttcgaggccctggagagcagcaccgccaccgacgtgttctgggccaagtacaccgcctgcgagaccgcccgcaccccccgcgacaagctggccgcctgcctggagggcaactgcgccgagggcctgggcaccaactaccgcggccacgtgaacatcacccgcagcggcatcgagtgccagctgtggcgcagccgctacccccacaagcccgagatcaacagcaccacccaccccggcgccgacctgcaggagaacttctgccgcaaccccgacagcagcaccaccggcccctggtgctacaccaccgaccccaccgtgcgccgccaggagtgcagcatccccgtgtgcggccaggaccaggtgaccgtggccatgaccccccgcagcgagggcagcagcgtgaacctgagcccccccctggagcagtgcgtgcccgaccgcggccagcagtaccagggccgcctggccgtgaccacccacggcctgccctgcctggcctgggccagcgcccaggccaaggccctgagcaagcaccaggacttcaacagcgccgtgcagctggtggagaacttctgccgcaaccccgacggcgacgaggagggcgtgtggtgctacgtggccggcaagcccggcgacttcggctactgcgacctgaactactgcgaggaggccgtggaggaggagaccggcgacggcctggacgaggacagcgaccgcgccatcgagggccgcaccgccaccagcgagtaccagaccttcttcaacccccgcaccttcggcagcggcgaggccgactgcggcctgcgccccctgttcgagaagaagagcctggaggacaagaccgagcgcgagctgctggagagctacatcgacggccgcatcgtggagggcagcgacgccgagatcggcatgagcccctggcaggtgatgctgttccgcaagagcccccaggagctgctgtgcggcgccagcctgatcagcgaccgctgggtgctgaccgccgcccactgcctgctgtaccccccctgggacaagaacttcaccgagaacgacctgctggtgcgcatcggcaagcacagccgcacccgctacgagcgcaacatcgagaagatcagcatgctggagaagatctacatccaccccagcctgctgcaggccggctacaagggccgcgtgaccggctggggcaacctgaaggagacctggaccgccaacgtgggcaagggccagcccagcgtgctgcaggtggtgaacctgcccatcgtggagcgccccgtgtgcaaggacagcacccgcatccgcatcaccgacaacatgttctgcgccggctacaagcccgacgagggcaagcgcggcgacgcctgcgagggcgacagcggcggccccttcgtgatgaagagccccttcaacaaccgctggtaccagatgggcatcgtgagctggggcgagggctgcgaccgcgacggcaagtacggcttctacacccacgtgttccgcctgaagaagtggatccagaaggtgatcgaccagttcggcgag

SEQ ID NO: 1425 - DNA, 885 bp, Artificial Sequence
  Description of Artificial Sequence: Synthetic coding sequence
atggagacccccgcctggccccgcgtgccccgccccgagaccgccgtggcccgcaccctgctgctgggctgggtgttcgcccaggtggccggcgccagcggcaccaccaacaccgtggccgcctacaacctgacctggaagagcaccaacttcaagaccatcctggagtgggagcccaagcccgtgaaccaggtgtacaccgtgcagatcagcaccaagagcggcgactggaagagcaagtgcttctacaccaccgacaccgagtgcgacctgaccgacgagatcgtgaaggacgtgaagcagacctacctggcccgcgtgttcagctaccccgccggcaacgtggagagcaccggcagcgccggcgagcccctgtacgagaacagccccgagttcaccccctacctggagaccaacctgggccagcccaccatccagagcttcgagcaggtgggcaccaaggtgaacgtgaccgtggaggacgagcgcaccctggtgcgccgcaacaacaccttcctgagcctgcgcgacgtgttcggcaaggacctgatctacaccctgtactactggaagagcagcagcagcggcaagaagaccgccaagaccaacaccaacgagttcctgatcgacgtggacaagggcgagaactactgcttcagcgtgcaggccgtgatccccagccgcaccgtgaaccgcaagagcaccgacagccccgtggagtgcatgggccaggagaagggcgagttccgcgagatcttctacatcatcggcgccgtggtgttcgtggtgatcatcctggtgatcatcctggccatcagcctgcacaagtgccgcaaggccggcgtgggccagagctggaaggagaacagccccctgaacgtgagc

SEQ ID NO: 1426 - DNA, 714 bp, Artificial Sequence
  Description of Artificial Sequence: Synthetic coding sequence
atggagacccccgcctggccccgcgtgccccgccccgagaccgccgtggcccgcaccctgctgctgggctgggtgttcgcccaggtggccggcgccagcggcaccaccaacaccgtggccgcctacaacctgacctggaagagcaccaacttcaagaccatcctggagtgggagcccaagcccgtgaaccaggtgtacaccgtgcagatcagcaccaagagcggcgactggaagagcaagtgcttctacaccaccgacaccgagtgcgacctgaccgacgagatcgtgaaggacgtgaagcagacctacctggcccgcgtgttcagctaccccgccggcaacgtggagagcaccggcagcgccggcgagcccctgtacgagaacagccccgagttcaccccctacctggagaccaacctgggccagcccaccatccagagcttcgagcaggtgggcaccaaggtgaacgtgaccgtggaggacgagcgcaccctggtgcgccgcaacaacaccttcctgagcctgcgcgacgtgttcggcaaggacctgatctacaccctgtactactggaagagcagcagcagcggcaagaagtacagcaccagcctggagctgtggtacctgtggagcagcagcctgagcagcagctggctgtacctgtacaccagcgtggagcgccaggagtggggccgcgccggccgccgcaccccccac

SEQ ID NO: 1427 - DNA, 1383 bp, Artificial Sequence
  Description of Artificial Sequence: Synthetic coding sequence
atgcagcgcgtgaacatgatcatggccgagagccccggcctgatcaccatctgcctgctgggctacctgctgagcgccgagtgcaccgtgttcctggaccacgagaacgccaacaagatcctgaaccgccccaagcgctacaacagcggcaagctggaggagttcgtgcagggcaacctggagcgcgagtgcatggaggagaagtgcagcttcgaggaggcccgcgaggtgttcgagaacaccgagcgcaccaccgagttctggaagcagtacgtggacggcgaccagtgcgagagcaacccctgcctgaacggcggcagctgcaaggacgacatcaacagctacgagtgctggtgccccttcggcttcgagggcaagaactgcgagctggacgtgacctgcaacatcaagaacggccgctgcgagcagttctgcaagaacagcgccgacaacaaggtggtgtgcagctgcaccgagggctaccgcctggccgagaaccagaagagctgcgagcccgccgtgcccttcccctgcggccgcgtgagcgtgagccagaccagcaagctgacccgcgccgagaccgtgttccccgacgtggactacgtgaacagcaccgaggccgagaccatcctggacaacatcacccagagcacccagagcttcaacgacttcacccgcgtggtgggcggcgaggacgccaagcccggccagttcccctggcaggtggtgctgaacggcaaggtggacgccttctgcggcggcagcatcgtgaacgagaagtggatcgtgaccgccgcccactgcgtggagaccggcgtgaagatcaccgtggtggccggcgagcacaacatcgaggagaccgagcacaccgagcagaagcgcaacgtgatccgcatcatcccccaccacaactacaacgccgccatcaacaagtacaaccacgacatcgccctgctggagctggacgagcccctggtgctgaacagctacgtgacccccatctgcatcgccgacaaggagtacaccaacatcttcctgaagttcggcagcggctacgtgagcggctggggccgcgtgttccacaagggccgcagcgccctggtgctgcagtacctgcgcgtgcccctggtggaccgcgccacctgcctgcgcagcaccaagttcaccatctacaacaacatgttctgcgccggcttccacgagggcggccgcgacagctgccagggcgacagcggcggcccccacgtgaccgaggtggagggcaccagcttcctgaccggcatcatcagctggggcgaggagtgcgccatgaagggcaagtacggcatctacaccaaggtgagccgctacgtgaactggatcaaggagaagaccaagctgacc

SEQ ID NO: 1428 - DNA, 1269 bp, Artificial Sequence
  Description of Artificial Sequence: Synthetic coding sequence
atgcagcgcgtgaacatgatcatggccgagagccccggcctgatcaccatctgcctgctgggctacctgctgagcgccgagtgcaccgtgttcctggaccacgagaacgccaacaagatcctgaaccgccccaagcgctacaacagcggcaagctggaggagttcgtgcagggcaacctggagcgcgagtgcatggaggagaagtgcagcttcgaggaggcccgcgaggtgttcgagaacaccgagcgcaccaccgagttctggaagcagtacgtggacgtgacctgcaacatcaagaacggccgctgcgagcagttctgcaagaacagcgccgacaacaaggtggtgtgcagctgcaccgagggctaccgcctggccgagaaccagaagagctgcgagcccgccgtgcccttcccctgcggccgcgtgagcgtgagccagaccagcaagctgacccgcgccgagaccgtgttccccgacgtggactacgtgaacagcaccgaggccgagaccatcctggacaacatcacccagagcacccagagcttcaacgacttcacccgcgtggtgggcggcgaggacgccaagcccggccagttcccctggcaggtggtgctgaacggcaaggtggacgccttctgcggcggcagcatcgtgaacgagaagtggatcgtgaccgccgcccactgcgtggagaccggcgtgaagatcaccgtggtggccggcgagcacaacatcgaggagaccgagcacaccgagcagaagcgcaacgtgatccgcatcatcccccaccacaactacaacgccgccatcaacaagtacaaccacgacatcgccctgctggagctggacgagcccctggtgctgaacagctacgtgacccccatctgcatcgccgacaaggagtacaccaacatcttcctgaagttcggcagcggctacgtgagcggctggggccgcgtgttccacaagggccgcagcgccctggtgctgcagtacctgcgcgtgcccctggtggaccgcgccacctgcctgcgcagcaccaagttcaccatctacaacaacatgttctgcgccggcttccacgagggcggccgcgacagctgccagggcgacagcggcggcccccacgtgaccgaggtggagggcaccagcttcctgaccggcatcatcagctggggcgaggagtgcgccatgaagggcaagtacggcatctacaccaaggtgagccgctacgtgaactggatcaaggagaagaccaagctgacc

SEQ ID NO: 1429 - DNA, 6687 bp, Artificial Sequence
  Description of Artificial Sequence: Synthetic coding sequence
atgttccccggctgcccccgcctgtgggtgctggtggtgctgggcaccagctgggtgggctggggcagccagggcaccgaggccgcccagctgcgccagttctacgtggccgcccagggcatcagctggagctaccgccccgagcccaccaacagcagcctgaacctgagcgtgaccagcttcaagaagatcgtgtaccgcgagtacgagccctacttcaagaaggagaagccccagagcaccatcagcggcctgctgggccccaccctgtacgccgaggtgggcgacatcatcaaggtgcacttcaagaacaaggccgacaagcccctgagcatccacccccagggcatccgctacagcaagctgagcgagggcgccagctacctggaccacaccttccccgccgagaagatggacgacgccgtggcccccggccgcgagtacacctacgagtggagcatcagcgaggacagcggccccacccacgacgaccccccctgcctgacccacatctactacagccacgagaacctgatcgaggacttcaacagcggcctgatcggccccctgctgatctgcaagaagggcaccctgaccgagggcggcacccagaagaccttcgacaagcagatcgtgctgctgttcgccgtgttcgacgagagcaagagctggagccagagcagcagcctgatgtacaccgtgaacggctacgtgaacggcaccatgcccgacatcaccgtgtgcgcccacgaccacatcagctggcacctgctgggcatgagcagcggccccgagctgttcagcatccacttcaacggccaggtgctggagcagaaccaccacaaggtgagcgccatcaccctggtgagcgccaccagcaccaccgccaacatgaccgtgggccccgagggcaagtggatcatcagcagcctgacccccaagcacctgcaggccggcatgcaggcctacatcgacatcaagaactgccccaagaagacccgcaacctgaagaagatcacccgcgagcagcgccgccacatgaagcgctgggagtacttcatcgccgccgaggaggtgatctgggactacgcccccgtgatccccgccaacatggacaagaagtaccgcagccagcacctggacaacttcagcaaccagatcggcaagcactacaagaaggtgatgtacacccagtacgaggacgagagcttcaccaagcacaccgtgaaccccaacatgaaggaggacggcatcctgggccccatcatccgcgcccaggtgcgcgacaccctgaagatcgtgttcaagaacatggccagccgcccctacagcatctacccccacggcgtgaccttcagcccctacgaggacgaggtgaacagcagcttcaccagcggccgcaacaacaccatgatccgcgccgtgcagcccggcgagacctacacctacaagtggaacatcctggagttcgacgagcccaccgagaacgacgcccagtgcctgacccgcccctactacagcgacgtggacatcatgcgcgacatcgccagcggcctgatcggcctgctgctgatctgcaagagccgcagcctggaccgccagggcatccagcgcgccgccgacatcgagcagcaggccgtgttcgccgtgttcgacgagaacaagagctggtacctggaggacaacatcaacaagttctgcgagaaccccgacgaggtgaagcgcgacgaccccaagttctacgagagcaacatcatgagcaacttcaccctgagcgccatcaacggctacgtgcccgagagcatcaccaccctgggcttctgcttcgacgacaccgtgcagtggcacttctgcagcgtgggcacccagaacgagatcctgaccatccacttcaccggccacagcttcatctacggcaagcgccacgaggacaccctgaccctgttccccatgcgcggcgagagcgtgaccgtgaccatggacaacgtgggcacctggatgctgaccagcatgaacagcagcccccgcagcaagaagctgcgcctgaagttccgcgacgtgaagtgcatccccgacgacgacgaggacagctacgagatcttcgagccccccgagagcaccgtgatggccacccgcaagatgcacgaccgcctggagcccgaggacgaggagagcgacgccgactacgactaccagaaccgcctggccgccgccctgggcatccgcagcttccgcaacagcagcctgaaccaggaggaggaggagttcaacctgaccgccctggccctggagaacggcaccgagttcgtgagcagcaacaccgacatcatcgtgggcagcaactacagcagccccagcaacatcagcaagttcaccgtgaacaacctggccgagccccagaaggcccccagccaccagcaggccaccaccgccggcagccccctgcgccacctgatcggcaagaacagcgtgctgaacagcagcaccgccgagcacagcagcccctacagcgaggaccccatcgaggaccccctgcagcccgacgtgaccggcatccgcctgctgagcctgggcgccggcgagttcaagagccaggagcacgccaagcacaagggccccaaggtggagcgcgaccaggccgccaagcaccgcttcagctggatgaagctgctggcccacaaggtgggccgccacctgagccaggacaccggcagccccagcggcatgcgcccctgggaggacctgcccagccaggacaccggcagccccagccgcatgcgcccctggaaggacccccccagcgacctgctgctgctgaagcagagcaacagcagcaagatcctggtgggccgctggcacctggccagcgagaagggcagctacgagatcatccaggacaccgacgaggacaccgccgtgaacaactggctgatcagcccccagaacgccagccgcgcctggggcgagagcacccccctggccaacaagcccggcaagcagagcggccaccccaagttcccccgcgtgcgccacaagagcctgcaggtgcgccaggacggcggcaagagccgcctgaagaagagccagttcctgatcaagacccgcaagaagaagaaggagaagcacacccaccacgcccccctgagcccccgcaccttccaccccctgcgcagcgaggcctacaacaccttcagcgagcgccgcctgaagcacagcctggtgctgcacaagagcaacgagaccagcctgcccaccgacctgaaccagaccctgcccagcatggacttcggctggatcgccagcctgcccgaccacaaccagaacagcagcaacgacaccggccaggccagctgcccccccggcctgtaccagaccgtgccccccgaggagcactaccagaccttccccatccaggaccccgaccagatgcacagcaccagcgaccccagccaccgcagcagcagccccgagctgagcgagatgctggagtacgaccgcagccacaagagcttccccaccgacatcagccagatgagccccagcagcgagcacgaggtgtggcagaccgtgatcagccccgacctgagccaggtgaccctgagccccgagctgagccagaccaacctgagccccgacctgagccacaccaccctgagccccgagctgatccagcgcaacctgagccccgccctgggccagatgcccatcagccccgacctgagccacaccaccctgagccccgacctgagccacaccaccctgagcctggacctgagccagaccaacctgagccccgagctgagccagaccaacctgagccccgccctgggccagatgcccctgagccccgacctgagccacaccaccctgagcctggacttcagccagaccaacctgagccccgagctgagccacatgaccctgagccccgagctgagccagaccaacctgagccccgccctgggccagatgcccatcagccccgacctgagccacaccaccctgagcctggacttcagccagaccaacctgagccccgagctgagccagaccaacctgagccccgccctgggccagatgcccctgagccccgaccccagccacaccaccctgagcctggacctgagccagaccaacctgagccccgagctgagccagaccaacctgagccccgacctgagcgagatgcccctgttcgccgacctgagccagatccccctgacccccgacctggaccagatgaccctgagccccgacctgggcgagaccgacctgagccccaacttcggccagatgagcctgagccccgacctgagccaggtgaccctgagccccgacatcagcgacaccaccctgctgcccgacctgagccagatcagccccccccccgacctggaccagatcttctaccccagcgagagcagccagagcctgctgctgcaggagttcaacgagagcttcccctaccccgacctgggccagatgcccagccccagcagccccaccctgaacgacaccttcctgagcaaggagttcaaccccctggtgatcgtgggcctgagcaaggacggcaccgactacatcgagatcatccccaaggaggaggtgcagagcagcgaggacgactacgccgagatcgactacgtgccctacgacgacccctacaagaccgacgtgcgcaccaacatcaacagcagccgcgaccccgacaacatcgccgcctggtacctgcgcagcaacaacggcaaccgccgcaactactacatcgccgccgaggagatcagctgggactacagcgagttcgtgcagcgcgagaccgacatcgaggacagcgacgacatccccgaggacaccacctacaagaaggtggtgttccgcaagtacctggacagcaccttcaccaagcgcgacccccgcggcgagtacgaggagcacctgggcatcctgggccccatcatccgcgccgaggtggacgacgtgatccaggtgcgcttcaagaacctggccagccgcccctacagcctgcacgcccacggcctgagctacgagaagagcagcgagggcaagacctacgaggacgacagccccgagtggttcaaggaggacaacgccgtgcagcccaacagcagctacacctacgtgtggcacgccaccgagcgcagcggccccgagagccccggcagcgcctgccgcgcctgggcctactacagcgccgtgaaccccgagaaggacatccacagcggcctgatcggccccctgctgatctgccagaagggcatcctgcacaaggacagcaacatgcccatggacatgcgcgagttcgtgctgctgttcatgaccttcgacgagaagaagagctggtactacgagaagaagagccgcagcagctggcgcctgaccagcagcgagatgaagaagagccacgagttccacgccatcaacggcatgatctacagcctgcccggcctgaagatgtacgagcaggagtgggtgcgcctgcacctgctgaacatcggcggcagccaggacatccacgtggtgcacttccacggccagaccctgctggagaacggcaacaagcagcaccagctgggcgtgtggcccctgctgcccggcagcttcaagaccctggagatgaaggccagcaagcccggctggtggctgctgaacaccgaggtgggcgagaaccagcgcgccggcatgcagacccccttcctgatcatggaccgcgactgccgcatgcccatgggcctgagcaccggcatcatcagcgacagccagatcaaggccagcgagttcctgggctactgggagccccgcctggcccgcctgaacaacggcggcagctacaacgcctggagcgtggagaagctggccgccgagttcgccagcaagccctggatccaggtggacatgcagaaggaggtgatcatcaccggcatccagacccagggcgccaagcactacctgaagagctgctacaccaccgagttctacgtggcctacagcagcaaccagatcaactggcagatcttcaagggcaacagcacccgcaacgtgatgtacttcaacggcaacagcgacgccagcaccatcaaggagaaccagttcgacccccccatcgtggcccgctacatccgcatcagccccacccgcgcctacaaccgccccaccctgcgcctggagctgcagggctgcgaggtgaacggctgcagcacccccctgggcatggagaacggcaagatcgagaacaagcagatcaccgccagcagcttcaagaagagctggtggggcgactactgggagcccttccgcgcccgcctgaacgcccagggccgcgtgaacgcctggcaggccaaggccaacaacaacaagcagtggctggagatcgacctgctgaagatcaagaagatcaccgccatcatcacccagggctgcaagagcctgagcagcgagatgtacgtgaagagctacaccatccactacagcgagcagggcgtggagtggaagccctaccgcctgaagagcagcatggtggacaagatcttcgagggcaacaccaacaccaagggccacgtgaagaacttcttcaacccccccatcatcagccgcttcatccgcgtgatccccaagacctggaaccagagcatcgccctgcgcctggagctgttcggctgcgacatctac

SEQ ID NO: 1430 - DNA, 6672 bp, Artificial Sequence
  Description of Artificial Sequence: Synthetic coding sequence
atgttccccggctgcccccgcctgtgggtgctggtggtgctgggcaccagctgggtgggctggggcagccagggcaccgaggccgcccagctgcgccagttctacgtggccgcccagggcatcagctggagctaccgccccgagcccaccaacagcagcctgaacctgagcgtgaccagcttcaagaagatcgtgtaccgcgagtacgagccctacttcaagaaggagaagccccagagcaccatcagcggcctgctgggccccaccctgtacgccgaggtgggcgacatcatcaaggtgcacttcaagaacaaggccgacaagcccctgagcatccacccccagggcatccgctacagcaagctgagcgagggcgccagctacctggaccacaccttccccgccgagaagatggacgacgccgtggcccccggccgcgagtacacctacgagtggagcatcagcgaggacagcggccccacccacgacgaccccccctgcctgacccacatctactacagccacgagaacctgatcgaggacttcaacagcggcctgatcggccccctgctgatctgcaagaagggcaccctgaccgagggcggcacccagaagaccttcgacaagcagatcgtgctgctgttcgccgtgttcgacgagagcaagagctggagccagagcagcagcctgatgtacaccgtgaacggctacgtgaacggcaccatgcccgacatcaccgtgtgcgcccacgaccacatcagctggcacctgctgggcatgagcagcggccccgagctgttcagcatccacttcaacggccaggtgctggagcagaaccaccacaaggtgagcgccatcaccctggtgagcgccaccagcaccaccgccaacatgaccgtgggccccgagggcaagtggatcatcagcagcctgacccccaagcacctgcaggccggcatgcaggcctacatcgacatcaagaactgccccaagaagacccgcaacctgaagaagatcacccgcgagcagcgccgccacatgaagcgctgggagtacttcatcgccgccgaggaggtgatctgggactacgcccccgtgatccccgccaacatggacaagaagtaccgcagccagcacctggacaacttcagcaaccagatcggcaagcactacaagaaggtgatgtacacccagtacgaggacgagagcttcaccaagcacaccgtgaaccccaacatgaaggaggacggcatcctgggccccatcatccgcgcccaggtgcgcgacaccctgaagatcgtgttcaagaacatggccagccgcccctacagcatctacccccacggcgtgaccttcagcccctacgaggacgaggtgaacagcagcttcaccagcggccgcaacaacaccatgatccgcgccgtgcagcccggcgagacctacacctacaagtggaacatcctggagttcgacgagcccaccgagaacgacgcccagtgcctgacccgcccctactacagcgacgtggacatcatgcgcgacatcgccagcggcctgatcggcctgctgctgatctgcaagagccgcagcctggaccgccagggcatccagcgcgccgccgacatcgagcagcaggccgtgttcgccgtgttcgacgagaacaagagctggtacctggaggacaacatcaacaagttctgcgagaaccccgacgaggtgaagcgcgacgaccccaagttctacgagagcaacatcatgagcaccatcaacggctacgtgcccgagagcatcaccaccctgggcttctgcttcgacgacaccgtgcagtggcacttctgcagcgtgggcacccagaacgagatcctgaccatccacttcaccggccacagcttcatctacggcaagcgccacgaggacaccctgaccctgttccccatgcgcggcgagagcgtgaccgtgaccatggacaacgtgggcacctggatgctgaccagcatgaacagcagcccccgcagcaagaagctgcgcctgaagttccgcgacgtgaagtgcatccccgacgacgacgaggacagctacgagatcttcgagccccccgagagcaccgtgatggccacccgcaagatgcacgaccgcctggagcccgaggacgaggagagcgacgccgactacgactaccagaaccgcctggccgccgccctgggcatccgcagcttccgcaacagcagcctgaaccaggaggaggaggagttcaacctgaccgccctggccctggagaacggcaccgagttcgtgagcagcaacaccgacatcatcgtgggcagcaactacagcagccccagcaacatcagcaagttcaccgtgaacaacctggccgagccccagaaggcccccagccaccagcaggccaccaccgccggcagccccctgcgccacctgatcggcaagaacagcgtgctgaacagcagcaccgccgagcacagcagcccctacagcgaggaccccatcgaggaccccctgcagcccgacgtgaccggcatccgcctgctgagcctgggcgccggcgagttcaagagccaggagcacgccaagcacaagggccccaaggtggagcgcgaccaggccgccaagcaccgcttcagctggatgaagctgctggcccacaaggtgggccgccacctgagccaggacaccggcagccccagcggcatgcgcccctgggaggacctgcccagccaggacaccggcagccccagccgcatgcgcccctggaaggacccccccagcgacctgctgctgctgaagcagagcaacagcagcaagatcctggtgggccgctggcacctggccagcgagaagggcagctacgagatcatccaggacaccgacgaggacaccgccgtgaacaactggctgatcagcccccagaacgccagccgcgcctggggcgagagcacccccctggccaacaagcccggcaagcagagcggccaccccaagttcccccgcgtgcgccacaagagcctgcaggtgcgccaggacggcggcaagagccgcctgaagaagagccagttcctgatcaagacccgcaagaagaagaaggagaagcacacccaccacgcccccctgagcccccgcaccttccaccccctgcgcagcgaggcctacaacaccttcagcgagcgccgcctgaagcacagcctggtgctgcacaagagcaacgagaccagcctgcccaccgacctgaaccagaccctgcccagcatggacttcggctggatcgccagcctgcccgaccacaaccagaacagcagcaacgacaccggccaggccagctgcccccccggcctgtaccagaccgtgccccccgaggagcactaccagaccttccccatccaggaccccgaccagatgcacagcaccagcgaccccagccaccgcagcagcagccccgagctgagcgagatgctggagtacgaccgcagccacaagagcttccccaccgacatcagccagatgagccccagcagcgagcacgaggtgtggcagaccgtgatcagccccgacctgagccaggtgaccctgagccccgagctgagccagaccaacctgagccccgacctgagccacaccaccctgagccccgagctgatccagcgcaacctgagccccgccctgggccagatgcccatcagccccgacctgagccacaccaccctgagccccgacctgagccacaccaccctgagcctggacctgagccagaccaacctgagccccgagctgagccagaccaacctgagccccgccctgggccagatgcccctgagccccgacctgagccacaccaccctgagcctggacttcagccagaccaacctgagccccgagctgagccacatgaccctgagccccgagctgagccagaccaacctgagccccgccctgggccagatgcccatcagccccgacctgagccacaccaccctgagcctggacttcagccagaccaacctgagccccgagctgagccagaccaacctgagccccgccctgggccagatgcccctgagccccgaccccagccacaccaccctgagcctggacctgagccagaccaacctgagccccgagctgagccagaccaacctgagccccgacctgagcgagatgcccctgttcgccgacctgagccagatccccctgacccccgacctggaccagatgaccctgagccccgacctgggcgagaccgacctgagccccaacttcggccagatgagcctgagccccgacctgagccaggtgaccctgagccccgacatcagcgacaccaccctgctgcccgacctgagccagatcagccccccccccgacctggaccagatcttctaccccagcgagagcagccagagcctgctgctgcaggagttcaacgagagcttcccctaccccgacctgggccagatgcccagccccagcagccccaccctgaacgacaccttcctgagcaaggagttcaaccccctggtgatcgtgggcctgagcaaggacggcaccgactacatcgagatcatccccaaggaggaggtgcagagcagcgaggacgactacgccgagatcgactacgtgccctacgacgacccctacaagaccgacgtgcgcaccaacatcaacagcagccgcgaccccgacaacatcgccgcctggtacctgcgcagcaacaacggcaaccgccgcaactactacatcgccgccgaggagatcagctgggactacagcgagttcgtgcagcgcgagaccgacatcgaggacagcgacgacatccccgaggacaccacctacaagaaggtggtgttccgcaagtacctggacagcaccttcaccaagcgcgacccccgcggcgagtacgaggagcacctgggcatcctgggccccatcatccgcgccgaggtggacgacgtgatccaggtgcgcttcaagaacctggccagccgcccctacagcctgcacgcccacggcctgagctacgagaagagcagcgagggcaagacctacgaggacgacagccccgagtggttcaaggaggacaacgccgtgcagcccaacagcagctacacctacgtgtggcacgccaccgagcgcagcggccccgagagccccggcagcgcctgccgcgcctgggcctactacagcgccgtgaaccccgagaaggacatccacagcggcctgatcggccccctgctgatctgccagaagggcatcctgcacaaggacagcaacatgcccatggacatgcgcgagttcgtgctgctgttcatgaccttcgacgagaagaagagctggtactacgagaagaagagccgcagcagctggcgcctgaccagcagcgagatgaagaagagccacgagttccacgccatcaacggcatgatctacagcctgcccggcctgaagatgtacgagcaggagtgggtgcgcctgcacctgctgaacatcggcggcagccaggacatccacgtggtgcacttccacggccagaccctgctggagaacggcaacaagcagcaccagctgggcgtgtggcccctgctgcccggcagcttcaagaccctggagatgaaggccagcaagcccggctggtggctgctgaacaccgaggtgggcgagaaccagcgcgccggcatgcagacccccttcctgatcatggaccgcgactgccgcatgcccatgggcctgagcaccggcatcatcagcgacagccagatcaaggccagcgagttcctgggctactgggagccccgcctggcccgcctgaacaacggcggcagctacaacgcctggagcgtggagaagctggccgccgagttcgccagcaagccctggatccaggtggacatgcagaaggaggtgatcatcaccggcatccagacccagggcgccaagcactacctgaagagctgctacaccaccgagttctacgtggcctacagcagcaaccagatcaactggcagatcttcaagggcaacagcacccgcaacgtgatgtacttcaacggcaacagcgacgccagcaccatcaaggagaaccagttcgacccccccatcgtggcccgctacatccgcatcagccccacccgcgcctacaaccgccccaccctgcgcctggagctgcagggctgcgaggtgaacggctgcagcacccccctgggcatggagaacggcaagatcgagaacaagcagatcaccgccagcagcttcaagaagagctggtggggcgactactgggagcccttccgcgcccgcctgaacgcccagggccgcgtgaacgcctggcaggccaaggccaacaacaacaagcagtggctggagatcgacctgctgaagatcaagaagatcaccgccatcatcacccagggctgcaagagcctgagcagcgagatgtacgtgaagagctacaccatccactacagcgagcagggcgtggagtggaagccctaccgcctgaagagcagcatggtggacaagatcttcgagggcaacaccaacaccaagggccacgtgaagaacttcttcaacccccccatcatcagccgcttcatccgcgtgatccccaagacctggaaccagagcatcgccctgcgcctggagctgttcggctgcgacatctac

SEQ ID NO: 1431 - DNA, 996 bp, Artificial Sequence
  Description of Artificial Sequence: Synthetic coding sequence
atggacgacgccgtggcccccggccgcgagtacacctacgagtggagcatcagcgaggacagcggccccacccacgacgaccccccctgcctgacccacatctactacagccacgagaacctgatcgaggacttcaacagcggcctgatcggccccctgctgatctgcaagaagggcaccctgaccgagggcggcacccagaagaccttcgacaagcagatcgtgctgctgttcgccgtgttcgacgagagcaagagctggagccagagcagcagcctgatgtacaccgtgaacggctacgtgaacggcaccatgcccgacatcaccgtgtgcgcccacgaccacatcagctggcacctgctgggcatgagcagcggccccgagctgttcagcatccacttcaacggccaggtgctggagcagaaccaccacaaggtgagcgccatcaccctggtgagcgccaccagcaccaccgccaacatgaccgtgggccccgagggcaagtggatcatcagcagcctgacccccaagcacctgcaggccggcatgcaggcctacatcgacatcaagaactgccccaagaagacccgcaacctgaagaagatcacccgcgagcagcgccgccacatgaagcgctgggagtacttcatcgccgccgaggaggtgatctgggactacgcccccgtgatccccgccaacatggacaagaagtaccgcagccagcacctggacaacttcagcaaccagatcggcaagcactacaagaaggtgatgtacacccagtacgaggacgagagcttcaccaagcacaccgtgaaccccaacatgaaggaggacggcatcctgggccccatcatccgcgcccaggtgcgcgacaccctgaagatcgtgttcaagaacatggccagccgcccctacagcatctacccccacggcgtgaccttcagcccctacgaggacgaggtgaacagcagcttcaccagcggcaccaccccc

SEQ ID NO: 1432 - DNA, 1332 bp, Artificial Sequence
  Description of Artificial Sequence: Synthetic coding sequence
atggtgagccaggccctgcgcctgctgtgcctgctgctgggcctgcagggctgcctggccgccgtgttcgtgacccaggaggaggcccacggcgtgctgcaccgccgccgccgcgccaacgccttcctggaggagctgcgccccggcagcctggagcgcgagtgcaaggaggagcagtgcagcttcgaggaggcccgcgagatcttcaaggacgccgagcgcaccaagctgttctggatcagctacagcgacggcgaccagtgcgccagcagcccctgccagaacggcggcagctgcaaggaccagctgcagagctacatctgcttctgcctgcccgccttcgagggccgcaactgcgagacccacaaggacgaccagctgatctgcgtgaacgagaacggcggctgcgagcagtactgcagcgaccacaccggcaccaagcgcagctgccgctgccacgagggctacagcctgctggccgacggcgtgagctgcacccccaccgtggagtacccctgcggcaagatccccatcctggagaagcgcaacgccagcaagccccagggccgcatcgtgggcggcaaggtgtgccccaagggcgagtgcccctggcaggtgctgctgctggtgaacggcgcccagctgtgcggcggcaccctgatcaacaccatctgggtggtgagcgccgcccactgcttcgacaagatcaagaactggcgcaacctgatcgccgtgctgggcgagcacgacctgagcgagcacgacggcgacgagcagagccgccgcgtggcccaggtgatcatccccagcacctacgtgcccggcaccaccaaccacgacatcgccctgctgcgcctgcaccagcccgtggtgctgaccgaccacgtggtgcccctgtgcctgcccgagcgcaccttcagcgagcgcaccctggccttcgtgcgcttcagcctggtgagcggctggggccagctgctggaccgcggcgccaccgccctggagctgatggtgctgaacgtgccccgcctgatgacccaggactgcctgcagcagagccgcaaggtgggcgacagccccaacatcaccgagtacatgttctgcgccggctacagcgacggcagcaaggacagctgcaagggcgacagcggcggcccccacgccacccactaccgcggcacctggtacctgaccggcatcgtgagctggggccagggctgcgccaccgtgggccacttcggcgtgtacacccgcgtgagccagtacatcgagtggctgcagaagctgatgcgcagcgagccccgccccggcgtgctgctgcgcgcccccttcccc

SEQ ID NO: 1433 - DNA, 1398 bp, Artificial Sequence
  Description of Artificial Sequence: Synthetic coding sequence
atggtgagccaggccctgcgcctgctgtgcctgctgctgggcctgcagggctgcctggccgccggcggcgtggccaaggccagcggcggcgagacccgcgacatgccctggaagcccggcccccaccgcgtgttcgtgacccaggaggaggcccacggcgtgctgcaccgccgccgccgcgccaacgccttcctggaggagctgcgccccggcagcctggagcgcgagtgcaaggaggagcagtgcagcttcgaggaggcccgcgagatcttcaaggacgccgagcgcaccaagctgttctggatcagctacagcgacggcgaccagtgcgccagcagcccctgccagaacggcggcagctgcaaggaccagctgcagagctacatctgcttctgcctgcccgccttcgagggccgcaactgcgagacccacaaggacgaccagctgatctgcgtgaacgagaacggcggctgcgagcagtactgcagcgaccacaccggcaccaagcgcagctgccgctgccacgagggctacagcctgctggccgacggcgtgagctgcacccccaccgtggagtacccctgcggcaagatccccatcctggagaagcgcaacgccagcaagccccagggccgcatcgtgggcggcaaggtgtgccccaagggcgagtgcccctggcaggtgctgctgctggtgaacggcgcccagctgtgcggcggcaccctgatcaacaccatctgggtggtgagcgccgcccactgcttcgacaagatcaagaactggcgcaacctgatcgccgtgctgggcgagcacgacctgagcgagcacgacggcgacgagcagagccgccgcgtggcccaggtgatcatccccagcacctacgtgcccggcaccaccaaccacgacatcgccctgctgcgcctgcaccagcccgtggtgctgaccgaccacgtggtgcccctgtgcctgcccgagcgcaccttcagcgagcgcaccctggccttcgtgcgcttcagcctggtgagcggctggggccagctgctggaccgcggcgccaccgccctggagctgatggtgctgaacgtgccccgcctgatgacccaggactgcctgcagcagagccgcaaggtgggcgacagccccaacatcaccgagtacatgttctgcgccggctacagcgacggcagcaaggacagctgcaagggcgacagcggcggcccccacgccacccactaccgcggcacctggtacctgaccggcatcgtgagctggggccagggctgcgccaccgtgggccacttcggcgtgtacacccgcgtgagccagtacatcgagtggctgcagaagctgatgcgcagcgagccccgccccggcgtgctgctgcgcgcccccttcccc

SEQ ID NO: 1434 - DNA, 1191 bp, Artificial Sequence
  Description of Artificial Sequence: Synthetic coding sequence
atgggcaacgtgaaccgccagggccagcactgccgcgacttcatcatggtgagccaggccctgcgcctgctgtgcctgctgctgggcctgcagggctgcctggccgccgacggcgaccagtgcgccagcagcccctgccagaacggcggcagctgcaaggaccagctgcagagctacatctgcttctgcctgcccgccttcgagggccgcaactgcgagacccacaaggacgaccagctgatctgcgtgaacgagaacggcggctgcgagcagtactgcagcgaccacaccggcaccaagcgcagctgccgctgccacgagggctacagcctgctggccgacggcgtgagctgcacccccaccgtggagtacccctgcggcaagatccccatcctggagaagcgcaacgccagcaagccccagggccgcatcgtgggcggcaaggtgtgccccaagggcgagtgcccctggcaggtgctgctgctggtgaacggcgcccagctgtgcggcggcaccctgatcaacaccatctgggtggtgagcgccgcccactgcttcgacaagatcaagaactggcgcaacctgatcgccgtgctgggcgagcacgacctgagcgagcacgacggcgacgagcagagccgccgcgtggcccaggtgatcatccccagcacctacgtgcccggcaccaccaaccacgacatcgccctgctgcgcctgcaccagcccgtggtgctgaccgaccacgtggtgcccctgtgcctgcccgagcgcaccttcagcgagcgcaccctggccttcgtgcgcttcagcctggtgagcggctggggccagctgctggaccgcggcgccaccgccctggagctgatggtgctgaacgtgccccgcctgatgacccaggactgcctgcagcagagccgcaaggtgggcgacagccccaacatcaccgagtacatgttctgcgccggctacagcgacggcagcaaggacagctgcaagggcgacagcggcggcccccacgccacccactaccgcggcacctggtacctgaccggcatcgtgagctggggccagggctgcgccaccgtgggccacttcggcgtgtacacccgcgtgagccagtacatcgagtggctgcagaagctgatgcgcagcgagccccgccccggcgtgctgctgcgcgcccccttcccc

SEQ ID NO: 1435 - DNA, 7053 bp, Artificial Sequence
  Description of Artificial Sequence: Synthetic coding sequence
atgcagatcgagctgagcacctgcttcttcctgtgcctgctgcgcttctgcttcagcgccacccgccgctactacctgggcgccgtggagctgagctgggactacatgcagagcgacctgggcgagctgcccgtggacgcccgcttccccccccgcgtgcccaagagcttccccttcaacaccagcgtggtgtacaagaagaccctgttcgtggagttcaccgaccacctgttcaacatcgccaagccccgccccccctggatgggcctgctgggccccaccatccaggccgaggtgtacgacaccgtggtgatcaccctgaagaacatggccagccaccccgtgagcctgcacgccgtgggcgtgagctactggaaggccagcgagggcgccgagtacgacgaccagaccagccagcgcgagaaggaggacgacaaggtgttccccggcggcagccacacctacgtgtggcaggtgctgaaggagaacggccccatggccagcgaccccctgtgcctgacctacagctacctgagccacgtggacctggtgaaggacctgaacagcggcctgatcggcgccctgctggtgtgccgcgagggcagcctggccaaggagaagacccagaccctgcacaagttcatcctgctgttcgccgtgttcgacgagggcaagagctggcacagcgagaccaagaacagcctgatgcaggaccgcgacgccgccagcgcccgcgcctggcccaagatgcacaccgtgaacggctacgtgaaccgcagcctgcccggcctgatcggctgccaccgcaagagcgtgtactggcacgtgatcggcatgggcaccacccccgaggtgcacagcatcttcctggagggccacaccttcctggtgcgcaaccaccgccaggccagcctggagatcagccccatcaccttcctgaccgcccagaccctgctgatggacctgggccagttcctgctgttctgccacatcagcagccaccagcacgacggcatggaggcctacgtgaaggtggacagctgccccgaggagccccagctgcgcatgaagaacaacgaggaggccgaggactacgacgacgacctgaccgacagcgagatggacgtggtgcgcttcgacgacgacaacagccccagcttcatccagatccgcagcgtggccaagaagcaccccaagacctgggtgcactacatcgccgccgaggaggaggactgggactacgcccccctggtgctggcccccgacgaccgcagctacaagagccagtacctgaacaacggcccccagcgcatcggccgcaagtacaagaaggtgcgcttcatggcctacaccgacgagaccttcaagacccgcgaggccatccagcacgagagcggcatcctgggccccctgctgtacggcgaggtgggcgacaccctgctgatcatcttcaagaaccaggccagccgcccctacaacatctacccccacggcatcaccgacgtgcgccccctgtacagccgccgcctgcccaagggcgtgaagcacctgaaggacttccccatcctgcccggcgagatcttcaagtacaagtggaccgtgaccgtggaggacggccccaccaagagcgacccccgctgcctgacccgctactacagcagcttcgtgaacatggagcgcgacctggccagcggcctgatcggccccctgctgatctgctacaaggagagcgtggaccagcgcggcaaccagatcatgagcgacaagcgcaacgtgatcctgttcagcgtgttcgacgagaaccgcagctggtacctgaccgagaacatccagcgcttcctgcccaaccccgccggcgtgcagctggaggaccccgagttccaggccagcaacatcatgcacagcatcaacggctacgtgttcgacagcctgcagctgagcgtgtgcctgcacgaggtggcctactggtacatcctgagcatcggcgcccagaccgacttcctgagcgtgttcttcagcggctacaccttcaagcacaagatggtgtacgaggacaccctgaccctgttccccttcagcggcgagaccgtgttcatgagcatggagaaccccggcctgtggatcctgggctgccacaacagcgacttccgcaaccgcggcatgaccgccctgctgaaggtgagcagctgcgacaagaacaccggcgactactacgaggacagctacgaggacatcagcgcctacctgctgagcaagaacaacgccatcgagccccgcagcttcagccagaacagccgccaccccagcacccgccagaagcagttcaacgccaccaccatccccgagaacgacatcgagaagaccgacccctggttcgcccaccgcacccccatgcccaagatccagaacgtgagcagcagcgacctgctgatgctgctgcgccagagccccaccccccacggcctgagcctgagcgacctgcaggaggccaagtacgagaccttcagcgacgaccccagccccggcgccatcgacagcaacaacagcctgagcgagatgacccacttccgcccccagctgcaccacagcggcgacatggtgttcacccccgagagcggcctgcagctgcgcctgaacgagaagctgggcaccaccgccgccaccgagctgaagaagctggacttcaaggtgagcagcaccagcaacaacctgatcagcaccatccccagcgacaacctggccgccggcaccgacaacaccagcagcctgggcccccccagcatgcccgtgcactacgacagccagctggacaccaccctgttcggcaagaagagcagccccctgaccgagagcggcggccccctgagcctgagcgaggagaacaacgacagcaagctgctggagagcggcctgatgaacagccaggagagcagctggggcaagaacgtgagcagcaccgagagcggccgcctgttcaagggcaagcgcgcccacggccccgccctgctgaccaaggacaacgccctgttcaaggtgagcatcagcctgctgaagaccaacaagaccagcaacaacagcgccaccaaccgcaagacccacatcgacggccccagcctgctgatcgagaacagccccagcgtgtggcagaacatcctggagagcgacaccgagttcaagaaggtgacccccctgatccacgaccgcatgctgatggacaagaacgccaccgccctgcgcctgaaccacatgagcaacaagaccaccagcagcaagaacatggagatggtgcagcagaagaaggagggccccatcccccccgacgcccagaaccccgacatgagcttcttcaagatgctgttcctgcccgagagcgcccgctggatccagcgcacccacggcaagaacagcctgaacagcggccagggccccagccccaagcagctggtgagcctgggccccgagaagagcgtggagggccagaacttcctgagcgagaagaacaaggtggtggtgggcaagggcgagttcaccaaggacgtgggcctgaaggagatggtgttccccagcagccgcaacctgttcctgaccaacctggacaacctgcacgagaacaacacccacaaccaggagaagaagatccaggaggagatcgagaagaaggagaccctgatccaggagaacgtggtgctgccccagatccacaccgtgaccggcaccaagaacttcatgaagaacctgttcctgctgagcacccgccagaacgtggagggcagctacgacggcgcctacgcccccgtgctgcaggacttccgcagcctgaacgacagcaccaaccgcaccaagaagcacaccgcccacttcagcaagaagggcgaggaggagaacctggagggcctgggcaaccagaccaagcagatcgtggagaagtacgcctgcaccacccgcatcagccccaacaccagccagcagaacttcgtgacccagcgcagcaagcgcgccctgaagcagttccgcctgcccctggaggagaccgagctggagaagcgcatcatcgtggacgacaccagcacccagtggagcaagaacatgaagcacctgacccccagcaccctgacccagatcgactacaacgagaaggagaagggcgccatcacccagagccccctgagcgactgcctgacccgcagccacagcatcccccaggccaaccgcagccccctgcccatcgccaaggtgagcagcttccccagcatccgccccatctacctgacccgcgtgctgttccaggacaacagcagccacctgcccgccgccagctaccgcaagaaggacagcggcgtgcaggagagcagccacttcctgcagggcgccaagaagaacaacctgagcctggccatcctgaccctggagatgaccggcgaccagcgcgaggtgggcagcctgggcaccagcgccaccaacagcgtgacctacaagaaggtggagaacaccgtgctgcccaagcccgacctgcccaagaccagcggcaaggtggagctgctgcccaaggtgcacatctaccagaaggacctgttccccaccgagaccagcaacggcagccccggccacctggacctggtggagggcagcctgctgcagggcaccgagggcgccatcaagtggaacgaggccaaccgccccggcaaggtgcccttcctgcgcgtggccaccgagagcagcgccaagacccccagcaagctgctggaccccctggcctgggacaaccactacggcacccagatccccaaggaggagtggaagagccaggagaagagccccgagaagaccgccttcaagaagaaggacaccatcctgagcctgaacgcctgcgagagcaaccacgccatcgccgccatcaacgagggccagaacaagcccgagatcgaggtgacctgggccaagcagggccgcaccgagcgcctgtgcagccagaacccccccgtgctgaagcgccaccagcgcgagatcacccgcaccaccctgcagagcgaccaggaggagatcgactacgacgacaccatcagcgtggagatgaagaaggaggacttcgacatctacgacgaggacgagaaccagagcccccgcagcttccagaagaagacccgccactacttcatcgccgccgtggagcgcctgtgggactacggcatgagcagcagcccccacgtgctgcgcaaccgcgcccagagcggcagcgtgccccagttcaagaaggtggtgttccaggagttcaccgacggcagcttcacccagcccctgtaccgcggcgagctgaacgagcacctgggcctgctgggcccctacatccgcgccgaggtggaggacaacatcatggtgaccttccgcaaccaggccagccgcccctacagcttctacagcagcctgatcagctacgaggaggaccagcgccagggcgccgagccccgcaagaacttcgtgaagcccaacgagaccaagacctacttctggaaggtgcagcaccacatggcccccaccaaggacgagttcgactgcaaggcctgggcctacttcagcgacgtggacctggagaaggacgtgcacagcggcctgatcggccccctgctggtgtgccacaccaacaccctgaaccccgcccacggccgccaggtgaccgtgcaggagttcgccctgttcttcaccatcttcgacgagaccaagagctggtacttcaccgagaacatggagcgcaactgccgcgccccctgcaacatccagatggaggaccccaccttcaaggagaactaccgcttccacgccatcaacggctacatcatggacaccctgcccggcctggtgatggcccaggaccagcgcatccgctggtacctgctgagcatgggcagcaacgagaacatccacagcatccacttcagcggccacgtgttcaccgtgcgcaagaaggaggagtacaagatggccctgtacaacctgtaccccggcgtgttcgagaccgtggagatgctgcccagcaaggccggcatctggcgcgtggagtgcctgatcggcgagcacctgcacgccggcatgagcaccctgttcctggtgtacagcaacaagtgccagacccccctgggcatggccagcggccacatccgcgacttccagatcaccgccagcggccagtacggccagtgggcccccaagctggcccgcctgcactacagcggcagcatcaacgcctggagcaccaaggagcccttcagctggatcaaggtggacctgctggcccccatgatcatccacggcatcaagacccagggcgcccgccagaagttcagcagcctgtacatcagccagttcatcatcatgtacagcctggacggcaagaagtggcagacctaccgcggcaacagcaccggcaccctgatggtgttcttcggcaacgtggacagcagcggcatcaagcacaacatcttcaacccccccatcatcgcccgctacatccgcctgcaccccacccactacagcatccgcagcaccctgcgcatggagctgatgggctgcgacctgaacagctgcagcatgcccctgggcatggagagcaaggccatcagcgacgcccagatcaccgccagcagctacttcaccaacatgttcgccacctggagccccagcaaggcccgcctgcacctgcagggccgcagcaacgcctggcgcccccaggtgaacaaccccaaggagtggctgcaggtggacttccagaagaccatgaaggtgaccggcgtgaccacccagggcgtgaagagcctgctgaccagcatgtacgtgaaggagttcctgatcagcagcagccaggacggccaccagtggaccctgttcttccagaacggcaaggtgaaggtgttccagggcaaccaggacagcttcacccccgtggtgaacagcctggacccccccctgctgacccgctacctgcgcatccacccccagagctgggtgcaccagatcgccctgcgcatggaggtgctgggctgcgaggcccaggacctgtac

SEQ ID NO: 1436 - DNA, 996 bp, Artificial Sequence
  Description of Artificial Sequence: Synthetic coding sequence
atgggccgccccctgcacctggtgctgctgagcgccagcctggccggcctgctgctgctgggcgagagcctgttcatccgccgcgagcaggccaacaacatcctggcccgcgtgacccgcgccaacagcttcctggaggagatgaagaagggccacctggagcgcgagtgcatggaggagacctgcagctacgaggaggcccgcgaggtgttcgaggacagcgacaagaccaacgagttctggaacaagtacaaggacggcgaccagtgcgagaccagcccctgccagaaccagggcaagtgcaaggacggcctgggcgagtacacctgcacctgcctggagggcttcgagggcaagaactgcgagctgttcacccgcaagctgtgcagcctggacaacggcgactgcgaccagttctgccacgaggagcagaacagcgtggtgtgcagctgcgcccgcggctacaccctggccgacaacggcaaggcctgcatccccaccggcccctacccctgcggcaagcagaccctggagcgccgcaagcgcagcgtggcccaggccaccagcagcagcggcgaggcccccgacagcatcacctggaagccctacgacgccgccgacctggaccccaccgagaaccccttcgacctgctggacttcaaccagacccagcccgagcgcggcgacaacaacctgacccgcatcgtgggcggccaggagtgcaaggacggcgagtgcccctggcaggccctgctgatcaacgaggagaacgagggcttctgcggcggcaccatcctgagcgagttctacatcctgaccgccgcccactgcctgtaccaggccaagcgcttcaagggcaccggcacccgcagccgccgccgcgccgtgcgccgctgcacccgctggcgctggagcagcagcaccaccggcagccagcgccgccccatgaccagcaccagcccctgcagcggcagccgcccccccagccccagcgcc

SEQ ID NO: 1437 - DNA, 1464 bp, Artificial Sequence
  Description of Artificial Sequence: Synthetic coding sequence
atgggccgccccctgcacctggtgctgctgagcgccagcctggccggcctgctgctgctgggcgagagcctgttcatccgccgcgagcaggccaacaacatcctggcccgcgtgacccgcgccaacagcttcctggaggagatgaagaagggccacctggagcgcgagtgcatggaggagacctgcagctacgaggaggcccgcgaggtgttcgaggacagcgacaagaccaacgagttctggaacaagtacaaggacggcgaccagtgcgagaccagcccctgccagaaccagggcaagtgcaaggacggcctgggcgagtacacctgcacctgcctggagggcttcgagggcaagaactgcgagctgttcacccgcaagctgtgcagcctggacaacggcgactgcgaccagttctgccacgaggagcagaacagcgtggtgtgcagctgcgcccgcggctacaccctggccgacaacggcaaggcctgcatccccaccggcccctacccctgcggcaagcagaccctggagcgccgcaagcgcagcgtggcccaggccaccagcagcagcggcgaggcccccgacagcatcacctggaagccctacgacgccgccgacctggaccccaccgagaaccccttcgacctgctggacttcaaccagacccagcccgagcgcggcgacaacaacctgacccgcatcgtgggcggccaggagtgcaaggacggcgagtgcccctggcaggccctgctgatcaacgaggagaacgagggcttctgcggcggcaccatcctgagcgagttctacatcctgaccgccgcccactgcctgtaccaggccaagcgcttcaaggtgcgcgtgggcgaccgcaacaccgagcaggaggagggcggcgaggccgtgcacgaggtggaggtggtgatcaagcacaaccgcttcaccaaggagacctacgacttcgacatcgccgtgctgcgcctgaagacccccatcaccttccgcatgaacgtggcccccgcctgcctgcccgagcgcgactgggccgagagcaccctgatgacccagaagaccggcatcgtgagcggcttcggccgcacccacgagaagggccgccagagcacccgcctgaagatgctggaggtgccctacgtggaccgcaacagctgcaagctgagcagcagcttcatcatcacccagaacatgttctgcgccggctacgacaccaagcaggaggacgcctgccagggcgacagcggcggcccccacgtgacccgcttcaaggacacctacttcgtgaccggcatcgtgagctggggcgagggctgcgcccgcaagggcaagtacggcatctacaccaaggtgaccgccttcctgaagtggatcgaccgcagcatgaagacccgcggcctgcccaaggccaagagccacgcccccgaggtgatcaccagcagccccctgaag

SEQ ID NO: 1438 - DNA, 1002 bp, Artificial Sequence
  Description of Artificial Sequence: Synthetic coding sequence
atgggccgccccctgcacctggtgctgctgagcgccagcctggccggcctgctgctgctgggcgagagcctgttcatccgccgcgagcaggccaacaacatcctggcccgcgtgacccgcgccaacagcttcctggaggagatgaagaagggccacctggagcgcgagtgcatggaggagacctgcagctacgaggaggcccgcgaggtgttcgaggacagcgacaagaccaacgagttctggaacaagtacaaggacggcgaccagtgcgagaccagcccctgccagaaccagggcaagtgcaaggacggcctgggcgagtacacctgcacctgcctggagggcttcgagggcaagaactgcgagctgttcacccgcaagctgtgcagcctggacaacggcgactgcgaccagttctgccacgaggagcagaacagcgtggtgtgcagctgcgcccgcggctacaccctggccgacaacggcaaggcctgcatccccaccggcccctacccctgcggcaagcagaccctggagcgccgcaagcgcagcgtggcccaggccaccagcagcagcggcgaggcccccgacagcatcacctggaagccctacgacgccgccgacctggaccccaccgagaaccccttcgacctgctggacttcaaccagacccagcccgagcgcggcgacaacaacctgacccgcatcgtgggcggccaggagtgcaaggacggcgagtgcccctggcaggccctgctgatcaacgaggagaacgagggcttctgcggcggcaccatcctgagcgagttctacatcctgaccgccgcccactgcctgtaccaggccaagcgcttcaaggtgcgcggcaccggcacccgcagccgccgccgcgccgtgcgccgctgcacccgctggcgctggagcagcagcaccaccggcagccagcgccgccccatgaccagcaccagcccctgcagcggcagccgcccccccagccccagcgcc

SEQ ID NO: 1439 - DNA, 1719 bp, Artificial Sequence
  Description of Artificial Sequence: Synthetic coding sequence
atgatcttcctgtaccaggtggtgcacttcatcctgttcaccagcgtgagcggcgagtgcgtgacccagctgctgaaggacacctgcttcgagggcggcgacatcaccaccgtgttcacccccagcgccaagtactgccaggtggtgtgcacctaccacccccgctgcctgctgttcaccttcaccgccgagagccccagcgaggaccccacccgctggttcacctgcgtgctgaaggacagcgtgaccgagaccctgccccgcgtgaaccgcaccgccgccatcagcggctacagcttcaagcagtgcagccaccagatcagcgtgaacaacatctgcctgctgaagcacacccagaccggcacccccacccgcatcaccaagctggacaaggtggtgagcggcttcagcctgaagagctgcgccctgagcaacctggcctgcatccgcgacatcttccccaacaccgtgttcgccgacagcaacatcgacagcgtgatggcccccgacgccttcgtgtgcggccgcatctgcacccaccaccccggctgcctgttcttcaccttcttcagccaggagtggcccaaggagagccagcgcaacctgtgcctgctgaagaccagcgagagcggcctgcccagcacccgcatcaagaagagcaaggccctgagcggcttcagcctgcagagctgccgccacagcatccccgtgttctgccacagcagcttctaccacgacaccgacttcctgggcgaggagctggacatcgtggccgccaagagccacgaggcctgccagaagctgtgcaccaacgccgtgcgctgccagttcttcacctacacccccgcccaggccagctgcaacgagggcaagggcaagtgctacctgaagctgagcagcaacggcagccccaccaagatcctgcacggccgcggcggcatcagcggctacaccctgcgcctgtgcaagatggacaacgagtgcaccaccaagatcaagccccgcatcgtgggcggcaccgccagcgtgcgcggcgagtggccctggcaggtgaccctgcacaccaccagccccacccagcgccacctgtgcggcggcagcatcatcggcaaccagtggatcctgaccgccgcccactgcttctacggcgtggagagccccaagatcctgcgcgtgtacagcggcatcctgaaccagagcgagatcaaggaggacaccagcttcttcggcgtgcaggagatcatcatccacgaccagtacaagatggccgagagcggctacgacatcgccctgctgaagctggagaccaccgtgaactacaccgacagccagcgccccatctgcctgcccagcaagggcgaccgcaacgtgatctacaccgactgctgggtgaccggctggggctaccgcaagctgcgcgacaagatccagaacaccctgcagaaggccaagatccccctggtgaccaacgaggagtgccagaagcgctaccgcggccacaagatcacccacaagatgatctgcgccggctaccgcgagggcggcaaggacgcctgcaagggcgacagcggcggccccctgagctgcaagcacaacgaggtgtggcacctggtgggcatcaccagctggggcgagggctgcgcccagcgcgagcgccccggcgtgtacaccaacgtggtggagtacgtggactggatcctggagaagacccaggccgtg

SEQ ID NO: 1440 - DNA, 1875 bp, Artificial Sequence
  Description of Artificial Sequence: Synthetic coding sequence
atgatcttcctgtaccaggtggtgcacttcatcctgttcaccagcgtgagcggcgagtgcgtgacccagctgctgaaggacacctgcttcgagggcggcgacatcaccaccgtgttcacccccagcgccaagtactgccaggtggtgtgcacctaccacccccgctgcctgctgttcaccttcaccgccgagagccccagcgaggaccccacccgctggttcacctgcgtgctgaaggacagcgtgaccgagaccctgccccgcgtgaaccgcaccgccgccatcagcggctacagcttcaagcagtgcagccaccagatcagcgcctgcaacaaggacatctacgtggacctggacatgaagggcatcaactacaacagcagcgtggccaagagcgcccaggagtgccaggagcgctgcaccgacgacgtgcactgccacttcttcacctacgccacccgccagttccccagcctggagcaccgcaacatctgcctgctgaagcacacccagaccggcacccccacccgcatcaccaagctggacaaggtggtgagcggcttcagcctgaagagctgcgccctgagcaacctggcctgcatccgcgacatcttccccaacaccgtgttcgccgacagcaacatcgacagcgtgatggcccccgacgccttcgtgtgcggccgcatctgcacccaccaccccggctgcctgttcttcaccttcttcagccaggagtggcccaaggagagccagcgcaacctgtgcctgctgaagaccagcgagagcggcctgcccagcacccgcatcaagaagagcaaggccctgagcggcttcagcctgcagagctgccgccacagcatccccgtgttctgccacagcagcttctaccacgacaccgacttcctgggcgaggagctggacatcgtggccgccaagagccacgaggcctgccagaagctgtgcaccaacgccgtgcgctgccagttcttcacctacacccccgcccaggccagctgcaacgagggcaagggcaagtgctacctgaagctgagcagcaacggcagccccaccaagatcctgcacggccgcggcggcatcagcggctacaccctgcgcctgtgcaagatggacaacgagtgcaccaccaagatcaagccccgcatcgtgggcggcaccgccagcgtgcgcggcgagtggccctggcaggtgaccctgcacaccaccagccccacccagcgccacctgtgcggcggcagcatcatcggcaaccagtggatcctgaccgccgcccactgcttctacggcgtggagagccccaagatcctgcgcgtgtacagcggcatcctgaaccagagcgagatcaaggaggacaccagcttcttcggcgtgcaggagatcatcatccacgaccagtacaagatggccgagagcggctacgacatcgccctgctgaagctggagaccaccgtgaactacaccgacagccagcgccccatctgcctgcccagcaagggcgaccgcaacgtgatctacaccgactgctgggtgaccggctggggctaccgcaagctgcgcgacaagatccagaacaccctgcagaaggccaagatccccctggtgaccaacgaggagtgccagaagcgctaccgcggccacaagatcacccacaagatgatctgcgccggctaccgcgagggcggcaaggacgcctgcaagggcgacagcggcggccccctgagctgcaagcacaacgaggtgtggcacctggtgggcatcaccagctggggcgagggctgcgcccagcgcgagcgccccggcgtgtacaccaacgtggtggagtacgtggactggatcctggagaagacccaggccgtg

SEQ ID NO: 1441 - DNA, 627 bp, Artificial Sequence
  Description of Artificial Sequence: Synthetic coding sequence
agcggcttcagcctgaagagctgcgccctgagcaacctggcctgcatccgcgacatcttccccaacaccgtgttcgccgacagcaacatcgacagcgtgatggcccccgacgccttcgtgtgcggccgcatctgcacccaccaccccggctgcctgttcttcaccttcttcagccaggagtggcccaaggagagccagcgcaacctgtgcctgctgaagaccagcgagagcggcctgcccagcacccgcatcaagaagagcaaggccctgagcggcttcagcctgcagagctgccgccacagcatccccgtgttctgccacagcagcttctaccacgacaccgacttcctgggcgaggagctggacatcgtggccgccaagagccacgaggcctgccagaagctgtgcaccaacgccgtgcgctgccagttcttcacctacacccccgcccaggccagctgcaacgagggcaagggcaagtgctacctgaagctgagcagcaacggcagccccaccaagatcctgcacggccgcggcggcatcagcggctacaccctgcgcctgtgcaagatggacaacgagctgcgcggcgcccccatgaagatcagcggctggctgaagaccagc

SEQ ID NO: 1442 - DNA, 2196 bp, Artificial Sequence
  Description of Artificial Sequence: Synthetic coding sequence
atgagcgagaccagccgcaccgccttcggcggccgccgcgccgtgccccccaacaacagcaacgccgccgaggacgacctgcccaccgtggagctgcagggcgtggtgccccgcggcgtgaacctgcaggagttcctgaacgtgaccagcgtgcacctgttcaaggagcgctgggacaccaacaaggtggaccaccacaccgacaagtacgagaacaacaagctgatcgtgcgccgcggccagagcttctacgtgcagatcgacttcagccgcccctacgacccccgccgcgacctgttccgcgtggagtacgtgatcggccgctacccccaggagaacaagggcacctacatccccgtgcccatcgtgagcgagctgcagagcggcaagtggggcgccaagatcgtgatgcgcgaggaccgcagcgtgcgcctgagcatccagagcagccccaagtgcatcgtgggcaagttccgcatgtacgtggccgtgtggaccccctacggcgtgctgcgcaccagccgcaaccccgagaccgacacctacatcctgttcaacccctggtgcgaggacgacgccgtgtacctggacaacgagaaggagcgcgaggagtacgtgctgaacgacatcggcgtgatcttctacggcgaggtgaacgacatcaagacccgcagctggagctacggccagttcgaggacggcatcctggacacctgcctgtacgtgatggaccgcgcccagatggacctgagcggccgcggcaaccccatcaaggtgagccgcgtgggcagcgccatggtgaacgccaaggacgacgagggcgtgctggtgggcagctgggacaacatctacgcctacggcgtgccccccagcgcctggaccggcagcgtggacatcctgctggagtaccgcagcagcgagaaccccgtgcgctacggccagtgctgggtgttcgccggcgtgttcaacaccttcctgcgctgcctgggcatccccgcccgcatcgtgaccaactacttcagcgcccacgacaacgacgccaacctgcagatggacatcttcctggaggaggacggcaacgtgaacagcaagctgaccaaggacagcgtgtggaactaccactgctggaacgaggcctggatgacccgccccgacctgcccgtgggcttcggcggctggcaggccgtggacagcaccccccaggagaacagcgacggcatgtaccgctgcggccccgccagcgtgcaggccatcaagcacggccacgtgtgcttccagttcgacgcccccttcgtgttcgccgaggtgaacagcgacctgatctacatcaccgccaagaaggacggcacccacgtggtggagaacgtggacgccacccacatcggcaagctgatcgtgaccaagcagatcggcggcgacggcatgatggacatcaccgacacctacaagttccaggagggccaggaggaggagcgcctggccctggagaccgccctgatgtacggcgccaagaagcccctgaacaccgagggcgtgatgaagagccgcagcaacgtggacatggacttcgaggtggagaacgccgtgctgggcaaggacttcaagctgagcatcaccttccgcaacaacagccacaaccgctacaccatcaccgcctacctgagcgccaacatcaccttctacaccggcgtgcccaaggccgagttcaagaaggagaccttcgacgtgaccctggagcccctgagcttcaagaaggaggccgtgctgatccaggccggcgagtacatgggccagctgctggagcaggccagcctgcacttcttcgtgaccgcccgcatcaacgagacccgcgacgtgctggccaagcagaagagcaccgtgctgaccatccccgagatcatcatcaaggtgcgcggcacccaggtggtgggcagcgacatgaccgtgaccgtggagttcaccaaccccctgaaggagaccctgcgcaacgtgtgggtgcacctggacggccccggcgtgacccgccccatgaagaagatgttccgcgagatccgccccaacagcaccgtgcagtgggaggaggtgtgccgcccctgggtgagcggccaccgcaagctgatcgccagcatgagcagcgacagcctgcgccacgtgtacggcgagctggacgtgcagatccagcgccgccccagcatg

SEQ ID NO: 1443 - DNA, 414 bp, Artificial Sequence
  Description of Artificial Sequence: Synthetic coding sequence
atgagcgagaccagccgcaccgccttcggcggccgccgcgccgtgccccccaacaacagcaacgccgccgaggacgacctgcccaccgtggagctgcagggcgtggtgccccgcggcgtgaacctgcaggagttcctgaacgtgaccagcgtgcacctgttcaaggagcgctgggacaccaacaaggtggaccaccacaccgacaagtacgagaacaacaagctgatcgtgcgccgcggccagagcttctacgtgcagatcgacttcagccgcccctacgacccccgccgcgacctgttccgcgtggagtacgtgatcggccgctacccccaggagaacaagggcacctacatccccgtgcccatcgtgagcgagctgcagagcggcaagtggggcgccaagatcgtgatgcgc

SEQ ID NO: 1444 - DNA, 3693 bp, Artificial Sequence
  Description of Artificial Sequence: Synthetic coding sequence
atgcgcctgctggccaagatcatctgcctgatgctgtgggccatctgcgtggccgaggactgcaacgagctgcccccccgccgcaacaccgagatcctgaccggcagctggagcgaccagacctaccccgagggcacccaggccatctacaagtgccgccccggctaccgcagcctgggcaacgtgatcatggtgtgccgcaagggcgagtgggtggccctgaaccccctgcgcaagtgccagaagcgcccctgcggccaccccggcgacacccccttcggcaccttcaccctgaccggcggcaacgtgttcgagtacggcgtgaaggccgtgtacacctgcaacgagggctaccagctgctgggcgagatcaactaccgcgagtgcgacaccgacggctggaccaacgacatccccatctgcgaggtggtgaagtgcctgcccgtgaccgcccccgagaacggcaagatcgtgagcagcgccatggagcccgaccgcgagtaccacttcggccaggccgtgcgcttcgtgtgcaacagcggctacaagatcgagggcgacgaggagatgcactgcagcgacgacggcttctggagcaaggagaagcccaagtgcgtggagatcagctgcaagagccccgacgtgatcaacggcagccccatcagccagaagatcatctacaaggagaacgagcgcttccagtacaagtgcaacatgggctacgagtacagcgagcgcggcgacgccgtgtgcaccgagagcggctggcgccccctgcccagctgcgaggagaagagctgcgacaacccctacatccccaacggcgactacagccccctgcgcatcaagcaccgcaccggcgacgagatcacctaccagtgccgcaacggcttctaccccgccacccgcggcaacaccgccaagtgcaccagcaccggctggatccccgccccccgctgcaccctgaagccctgcgactaccccgacatcaagcacggcggcctgtaccacgagaacatgcgccgcccctacttccccgtggccgtgggcaagtactacagctactactgcgacgagcacttcgagacccccagcggcagctactgggaccacatccactgcacccaggacggctggagccccgccgtgccctgcctgcgcaagtgctacttcccctacctggagaacggctacaaccagaaccacggccgcaagttcgtgcagggcaagagcatcgacgtggcctgccaccccggctacgccctgcccaaggcccagaccaccgtgacctgcatggagaacggctggagccccaccccccgctgcatccgcgtgaagacctgcagcaagagcagcatcgacatcgagaacggcttcatcagcgagagccagtacacctacgccctgaaggagaaggccaagtaccagtgcaagctgggctacgtgaccgccgacggcgagaccagcggcagcatcacctgcggcaaggacggctggagcgcccagcccacctgcatcaagagctgcgacatccccgtgttcatgaacgcccgcaccaagaacgacttcacctggttcaagctgaacgacaccctggactacgagtgccacgacggctacgagagcaacaccggcagcaccaccggcagcatcgtgtgcggctacaacggctggagcgacctgcccatctgctacgagcgcgagtgcgagctgcccaagatcgacgtgcacctggtgcccgaccgcaagaaggaccagtacaaggtgggcgaggtgctgaagttcagctgcaagcccggcttcaccatcgtgggccccaacagcgtgcagtgctaccacttcggcctgagccccgacctgcccatctgcaaggagcaggtgcagagctgcggccccccccccgagctgctgaacggcaacgtgaaggagaagaccaaggaggagtacggccacagcgaggtggtggagtactactgcaacccccgcttcctgatgaagggccccaacaagatccagtgcgtggacggcgagtggaccaccctgcccgtgtgcatcgtggaggagagcacctgcggcgacatccccgagctggagcacggctgggcccagctgagcagccccccctactactacggcgacagcgtggagttcaactgcagcgagagcttcaccatgatcggccaccgcagcatcacctgcatccacggcgtgtggacccagctgccccagtgcgtggccatcgacaagctgaagaagtgcaagagcagcaacctgatcatcctggaggagcacctgaagaacaagaaggagttcgaccacaacagcaacatccgctaccgctgccgcggcaaggagggctggatccacaccgtgtgcatcaacggccgctgggaccccgaggtgaactgcagcatggcccagatccagctgtgccccccccccccccagatccccaacagccacaacatgaccaccaccctgaactaccgcgacggcgagaaggtgagcgtgctgtgccaggagaactacctgatccaggagggcgaggagatcacctgcaaggacggccgctggcagagcatccccctgtgcgtggagaagatcccctgcagccagcccccccagatcgagcacggcaccatcaacagcagccgcagcagccaggagagctacgcccacggcaccaagctgagctacacctgcgagggcggcttccgcatcagcgaggagaacgagaccacctgctacatgggcaagtggagcagccccccccagtgcgagggcctgccctgcaagagcccccccgagatcagccacggcgtggtggcccacatgagcgacagctaccagtacggcgaggaggtgacctacaagtgcttcgagggcttcggcatcgacggccccgccatcgccaagtgcctgggcgagaagtggagccacccccccagctgcatcaagaccgactgcctgagcctgcccagcttcgagaacgccatccccatgggcgagaagaaggacgtgtacaaggccggcgagcaggtgacctacacctgcgccacctactacaagatggacggcgccagcaacgtgacctgcatcaacagccgctggaccggccgccccacctgccgcgacaccagctgcgtgaacccccccaccgtgcagaacgcctacatcgtgagccgccagatgagcaagtaccccagcggcgagcgcgtgcgctaccagtgccgcagcccctacgagatgttcggcgacgaggaggtgatgtgcctgaacggcaactggaccgagcccccccagtgcaaggacagcaccggcaagtgcggcccccccccccccatcgacaacggcgacatcaccagcttccccctgagcgtgtacgcccccgccagcagcgtggagtaccagtgccagaacctgtaccagctggagggcaacaagcgcatcacctgccgcaacggccagtggagcgagccccccaagtgcctgcacccctgcgtgatcagccgcgagatcatggagaactacaacatcgccctgcgctggaccgccaagcagaagctgtacagccgcaccggcgagagcgtggagttcgtgtgcaagcgcggctaccgcctgagcagccgcagccacaccctgcgcaccacctgctgggacggcaagctggagtaccccacctgcgccaagcgc

SEQ ID NO: 1445 - DNA, 1347 bp, Artificial Sequence
  Description of Artificial Sequence: Synthetic coding sequence
atgcgcctgctggccaagatcatctgcctgatgctgtgggccatctgcgtggccgaggactgcaacgagctgcccccccgccgcaacaccgagatcctgaccggcagctggagcgaccagacctaccccgagggcacccaggccatctacaagtgccgccccggctaccgcagcctgggcaacgtgatcatggtgtgccgcaagggcgagtgggtggccctgaaccccctgcgcaagtgccagaagcgcccctgcggccaccccggcgacacccccttcggcaccttcaccctgaccggcggcaacgtgttcgagtacggcgtgaaggccgtgtacacctgcaacgagggctaccagctgctgggcgagatcaactaccgcgagtgcgacaccgacggctggaccaacgacatccccatctgcgaggtggtgaagtgcctgcccgtgaccgcccccgagaacggcaagatcgtgagcagcgccatggagcccgaccgcgagtaccacttcggccaggccgtgcgcttcgtgtgcaacagcggctacaagatcgagggcgacgaggagatgcactgcagcgacgacggcttctggagcaaggagaagcccaagtgcgtggagatcagctgcaagagccccgacgtgatcaacggcagccccatcagccagaagatcatctacaaggagaacgagcgcttccagtacaagtgcaacatgggctacgagtacagcgagcgcggcgacgccgtgtgcaccgagagcggctggcgccccctgcccagctgcgaggagaagagctgcgacaacccctacatccccaacggcgactacagccccctgcgcatcaagcaccgcaccggcgacgagatcacctaccagtgccgcaacggcttctaccccgccacccgcggcaacaccgccaagtgcaccagcaccggctggatccccgccccccgctgcaccctgaagccctgcgactaccccgacatcaagcacggcggcctgtaccacgagaacatgcgccgcccctacttccccgtggccgtgggcaagtactacagctactactgcgacgagcacttcgagacccccagcggcagctactgggaccacatccactgcacccaggacggctggagccccgccgtgccctgcctgcgcaagtgctacttcccctacctggagaacggctacaaccagaaccacggccgcaagttcgtgcagggcaagagcatcgacgtggcctgccaccccggctacgccctgcccaaggcccagaccaccgtgacctgcatggagaacggctggagccccaccccccgctgcatccgcgtgagcttcaccctg

SEQ ID NO: 1446 - DNA, 570 bp, Artificial Sequence
  Description of Artificial Sequence: Synthetic coding sequence
atggccgccggcgagctggagggcggcaagcccctgagcggcctgctgaacgccctggcccaggacaccttccacggctaccccggcatcaccgaggagctgctgcgcagccagctgtaccccgaggtgccccccgaggagttccgccccttcctggccaagatgcgcggcatcctgaagagcatcgccagcgccgacatggacttcaaccagctggaggccttcctgaccgcccagaccaagaagcagggcggcatcaccagcgaccaggccgccgtgatcagcaagttctggaagagccacaagaccaagatccgcgagagcctgatgaaccagagccgctggaacagcggcctgcgcggcctgagctggcgcgtggacggcaagagccagagccgccacagcgcccagatccacacccccgtggccatcatcgagctggagctgggcaagtacggccaggagagcgagttcctgtgcctggagttcgacgaggtgaaggtgaaccagatcctgaagaccctgagcgaggtggaggagagcatcagcaccctgatcagccagcccaac

SEQ ID NO: 1447 - DNA, 111 bp, Artificial Sequence
  Description of Artificial Sequence: Synthetic coding sequence
caggagagcgagttcctgtgcctggagttcgacgaggtgaaggtgaaccagatcctgaagaccctgagcgaggtggaggagagcatcagcaccctgatcagccagcccaac

SEQ ID NO: 1448 - DNA, 93 bp, Artificial Sequence
  Description of Artificial Sequence: Synthetic coding sequence
tgcctggagttcgacgaggtgaaggtgaaccagatcctgaagaccctgagcgaggtggaggagagcatcagcaccctgatcagccagcccaac

SEQ ID NO: 1449 - DNA, 477 bp, Artificial Sequence
  Description of Artificial Sequence: Synthetic coding sequence
atggccgccggcgagctggagggcggcaagcccctgagcggcctgctgaacgccctggcccaggacaccttccacggctaccccggcatcaccgaggagctgctgcgcagccagctgtaccccgaggtgccccccgaggagttccgccccttcctggccaagatgcgcggcatcctgaagagcatcgccagcgccgacatggacttcaaccagctggaggccttcctgaccgcccagaccaagaagcagggcggcatcaccagcgaccaggccgccgtgatcagcaagttctggaagagccacaagaccaagatccgcgagagcctgatgaaccagagccgctggaacagcggcctgcgcggcctgagctggcgcgtggacggcaagagccagagccgccacagcgcccagatccacacccccgtggccatcatcgagctggagctgggcaagtacggccaggtgcactgcaaccag

SEQ ID NO: 1450 - DNA, 4440 bp, Artificial Sequence
  Description of Artificial Sequence: Synthetic coding sequence
atgcagcgcagccccctggagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggcgcttcatgttctacggcatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagacccccctgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaggtgagcctggccccccaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagctgttcccccaccgcaacagcagcaagtgcaagagcaagccccagatcgccgccctgaaggaggagaccgaggaggaggtgcaggacacccgcctg

SEQ ID NO: 1451 - DNA, 4314 bp, Artificial Sequence
  Description of Artificial Sequence: Synthetic coding sequence
atgcagcgcagccccctggagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggcgcttcatgttctacggcatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagacccccctgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaggtgagcctggccccccaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagctgttcccccaccgcaacagcagcaagtgcaagagcaagccccagatcgccgccctgaag

SEQ ID NO: 1452 - DNA, 4257 bp, Artificial Sequence
  Description of Artificial Sequence: Synthetic coding sequence
atgcagcgcagccccctggagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggcgcttcatgttctacggcatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagacccccctgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaggtgagcctggccccccaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagctgttcccccaccgcaacagcagcaagtgcaagagcaagccccagatcgccgccctgaaggaggagaccgaggaggaggtgcaggacacccgcctg

SEQ ID NO: 1453 - DNA, 567 bp, Artificial Sequence
  Description of Artificial Sequence: Synthetic coding sequence
aagggcctgtggaccctgcgcgccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgcgcttcgagcactgcctgctgtgc

SEQ ID NO: 1454 - DNA, 1101 bp, Artificial Sequence
  Description of Artificial Sequence: Synthetic coding sequence
atgatccgcaactggctgaccatcttcatcctgttccccctgaagctggtggagaagtgcgagagcagcgtgagcctgaccgtgccccccgtggtgaagctggagaacggcagcagcaccaacgtgagcctgaccctgcgcccccccctgaacgccaccctggtgatcaccttcgagatcaccttccgcagcaagaacatcaccatcctggagctgcccgacgaggtggtggtgccccccggcgtgaccaacagcagcttccaggtgaccagccagaacgtgggccagctgaccgtgtacctgcacggcaaccacagcaaccagaccggcccccgcatccgcttcctggtgatccgcagcagcgccatcagcatcatcaaccaggtgatcggctggatctacttcgtggcctggagcatcagcttctacccccaggtgatcatgaactggcgccgcaagagcgtgatcggcctgagcttcgacttcgtggccctgaacctgaccggcttcgtggcctacagcgtgttcaacatcggcctgctgtgggtgccctacatcaaggagcagttcctgctgaagtaccccaacggcgtgaaccccgtgaacagcaacgacgtgttcttcagcctgcacgccgtggtgctgaccctgatcatcatcgtgcagtgctgcctgtacgagcgcggcggccagcgcgtgagctggcccgccatcggcttcctggtgctggcctggctgttcgccttcgtgaccatgatcgtggccgccgtgggcgtgaccacctggctgcagttcctgttctgcttcagctacatcaagctggccgtgaccctggtgaagtacttcccccaggcctacatgaacttctactacaagagcaccgagggctggagcatcggcaacgtgctgctggacttcaccggcggcagcttcagcctgctgcagatgttcctgcagagctacaacaacgaccagtggaccctgatcttcggcgaccccaccaagttcggcctgggcgtgttcagcatcgtgttcgacgtggtgttcttcatccagcacttctgcctgtaccgcaagcgccccggctacgaccagctgaac

SEQ ID NO: 1455 - DNA, 660 bp, Artificial Sequence
  Description of Artificial Sequence: Synthetic coding sequence
atgaactggcgccgcaagagcgtgatcggcctgagcttcgacttcgtggccctgaacctgaccggcttcgtggcctacagcgtgttcaacatcggcctgctgtgggtgccctacatcaaggagcagttcctgctgaagtaccccaacggcgtgaaccccgtgaacagcaacgacgtgttcttcagcctgcacgccgtggtgctgaccctgatcatcatcgtgcagtgctgcctgtacgagcgcggcggccagcgcgtgagctggcccgccatcggcttcctggtgctggcctggctgttcgccttcgtgaccatgatcgtggccgccgtgggcgtgaccacctggctgcagttcctgttctgcttcagctacatcaagctggccgtgaccctggtgaagtacttcccccaggcctacatgaacttctactacaagagcaccgagggctggagcatcggcaacgtgctgctggacttcaccggcggcagcttcagcctgctgcagatgttcctgcagagctacaacaacgaccagtggaccctgatcttcggcgaccccaccaagttcggcctgggcgtgttcagcatcgtgttcgacgtggtgttcttcatccagcacttctgcctgtaccgcaagcgccccggctacgaccagctgaac

SEQ ID NO: 1456 - DNA, 876 bp, Artificial Sequence
  Description of Artificial Sequence: Synthetic coding sequence
atgtgcccccgcatccgcttcctggtgatccgcagcagcgccatcagcatcatcaaccaggtgatcggctggatctacttcgtggcctggagcatcagcttctacccccaggtgatcatgaactggcgccgcaagagcgtgatcggcctgagcttcgacttcgtggccctgaacctgaccggcttcgtggcctacagcgtgttcaacatcggcctgctgtgggtgccctacatcaaggagcagttcctgctgaagtaccccaacggcgtgaaccccgtgaacagcaacgacgtgttcttcagcctgcacgccgtggtgctgaccctgatcatcatcgtgcagtgctgcctgtacgagcgcggcggccagcgcgtgagctggcccgccatcggcttcctggtgctggcctggctgttcgccttcgtgaccatgatcgtggccgccgtgggcgtgaccacctggctgcagttcctgttctgcttcagctacatcaagctggccgtgaccctggtgaagtacttcccccaggcctacatgaacttctactacaagagcaccgagggctggagcatcggcaacgtgctgctggacttcaccggcggcagcttcagcctgctgcagatgttcctgcagagctacaacaacgaccagtggaccctgatcttcggcgaccccaccaagttcggcctgggcgtgttcagcatcgtgttcgacgtggtgttcttcatccagcacttctgcctgtaccgcaagcgccccggcctgcaggccgcccgcaccggcagcggcagccgcctgcgccaggactgggcccccagcctgcagcccaaggccctgccccagaccaccagcgtgagcgccagcagcctgaagggc

SEQ ID NO: 1457 - DNA, 225 bp, Artificial Sequence
  Description of Artificial Sequence: Synthetic coding sequence
atgatccgcaactggctgaccatcttcatcctgttccccctgaagctggtggagaagtgcgagagcagcgtgagcctgaccgtgccccccgtggtgaagctggagaacggcagcagcaccaacgtgagcctgaccctgcgcccccccctgaacgccaccctggtgatcaccttcgagatcaccttccgcagcaagaacatcaccatcctggagctgcccgacgag

SEQ ID NO: 1458 - DNA, 6240 bp, Artificial Sequence
  Description of Artificial Sequence: Synthetic coding sequence
atgctgcgcgtgttcatcctgtacgccgagaacgtgcacacccccgacaccgacatcagcgacgcctactgcagcgccgtgttcgccggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1459 - DNA, 6243 bp, Artificial Sequence
  Description of Artificial Sequence: Synthetic coding sequence
atgctgtgctgcctgctggtgcgcgccagcaacctgcccagcgccaagaaggaccgccgcagcgaccccgtggccagcctgaccttccgcggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1460 - DNA, 6306 bp, Artificial Sequence
  Description of Artificial Sequence: Synthetic coding sequence
atgctgtgctgcctgctggtgcgcgccagcaacctgcccagcgccaagaaggaccgccgcagcgaccccgtggccagcctgaccttccgcggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1461 - DNA, 6354 bp, Artificial Sequence
  Description of Artificial Sequence: Synthetic coding sequence
atgctgcgcgtgttcatcctgtacgccgagaacgtgcacacccccgacaccgacatcagcgacgcctactgcagcgccgtgttcgccggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagccgcgccgagacctggagcctgctgagcgacagcaccatggacacccgctacagcggcaagaagtggcccgcccccaccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggtggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1462 - DNA, 6336 bp, Artificial Sequence
  Description of Artificial Sequence: Synthetic coding sequence
atgctgtgctgcctgctggtgcgcgccagcaacctgcccagcgccaagaaggaccgccgcagcgaccccgtggccagcctgaccttccgcggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagccgcgccgagacctggagcctgctgagcgacagcaccatggacacccgctacagcggcaagaagtggcccgcccccaccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1463 - DNA, 6264 bp, Artificial Sequence
  Description of Artificial Sequence: Synthetic coding sequence
atgctgtgctgcctgctggtgcgcgccagcaacctgcccagcgccaagaaggaccgccgcagcgaccccgtggccagcctgaccttccgcggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggtggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1464 - DNA, 6291 bp, Artificial Sequence
  Description of Artificial Sequence: Synthetic coding sequence
atgctgcgcgtgttcatcctgtacgccgagaacgtgcacacccccgacaccgacatcagcgacgcctactgcagcgccgtgttcgccggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagccgcgccgagacctggagcctgctgagcgacagcaccatggacacccgctacagcggcaagaagtggcccgcccccaccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggtggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1465 - DNA, 6357 bp, Artificial Sequence
  Description of Artificial Sequence: Synthetic coding sequence
atgctgtgctgcctgctggtgcgcgccagcaacctgcccagcgccaagaaggaccgccgcagcgaccccgtggccagcctgaccttccgcggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagccgcgccgagacctggagcctgctgagcgacagcaccatggacacccgctacagcggcaagaagtggcccgcccccaccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggtggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1466 - DNA, 6294 bp, Artificial Sequence
  Description of Artificial Sequence: Synthetic coding sequence
atgctgtgctgcctgctggtgcgcgccagcaacctgcccagcgccaagaaggaccgccgcagcgaccccgtggccagcctgaccttccgcggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagccgcgccgagacctggagcctgctgagcgacagcaccatggacacccgctacagcggcaagaagtggcccgcccccaccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggtggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1467 - DNA, 6333 bp, Artificial Sequence
  Description of Artificial Sequence: Synthetic coding sequence
atgctgcgcgtgttcatcctgtacgccgagaacgtgcacacccccgacaccgacatcagcgacgcctactgcagcgccgtgttcgccggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagccgcgccgagacctggagcctgctgagcgacagcaccatggacacccgctacagcggcaagaagtggcccgcccccaccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1468 - DNA, 6303 bp, Artificial Sequence
  Description of Artificial Sequence: Synthetic coding sequence
atgctgcgcgtgttcatcctgtacgccgagaacgtgcacacccccgacaccgacatcagcgacgcctactgcagcgccgtgttcgccggcgtgaagaagcgcaccaaggtgatcaagaacagcgtgaaccccgtgtggaacgagggcttcgagtgggacctgaagggcatccccctggaccagggcagcgagctgcacgtggtggtgaaggaccacgagaccatgggccgcaaccgcttcctgggcgaggccaaggtgcccctgcgcgaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccaccccccgcaagctgcccagccgcccccccccccactaccccggcatcaagcgcaagcgcagcgcccccaccagccgcaagctgctgagcgacaagccccaggacttccagatccgcgtgcaggtgatcgagggccgccagctgcccggcgtgaacatcaagcccgtggtgaaggtgaccgccgccggccagaccaagcgcacccgcatccacaagggcaacagccccctgttcaacgagaccctgttcttcaacctgttcgacagccccggcgagctgttcgacgagcccatcttcatcaccgtggtggacagccgcagcctgcgcaccgacgccctgctgggcgagttccgcatggacgtgggcaccatctaccgcgagccccgccacgcctacctgcgcaagtggctgctgctgagcgaccccgacgacttcagcgccggcgcccgcggctacctgaagaccagcctgtgcgtgctgggccccggcgacgaggcccccctggagcgcaaggaccccagcgaggacaaggaggacatcgagagcaacctgctgcgccccaccggcgtggccctgcgcggcgcccacttctgcctgaaggtgttccgcgccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgcgcatccgcatcatcgactgggaccgcctgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagcccccgcgagttcaccggcttccccgacccctacaccgagctgaacaccggcaagggcgagggcgtggcctaccgcggccgcctgctgctgagcctggagaccaagctggtggagcacagcgagcagaaggtggaggacctgcccgccgacgacatcctgcgcgtggagaagtacctgcgccgccgcaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagccgcgccgtgttcgacggctgccactactactacctgccctggggcaacgtgaagcccgtggtggtgctgagcagctactgggaggacatcagccaccgcatcgagacccagaaccagctgctgggcatcgccgaccgcctggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgcgcacccaccacctgagccagatcaccgaggccgccctggccctgaagctgggccacagcgagctgcccgccgccctggagcaggccgaggactggctgctgcgcctgcgcgccctggccgaggagccccagaacagcctgcccgacatcgtgatctggatgctgcagggcgacaagcgcgtggcctaccagcgcgtgcccgcccaccaggtgctgttcagccgccgcggcgccaactactgcggcaagaactgcggcaagctgcagaccatcttcctgaagtaccccatggagaaggtgcccggcgcccgcatgcccgtgcagatccgcgtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttccgccccagcgccggctggacctgggccggcgactggttcgtgtgccccgagaagaccctgctgcacgacatggacgccggccacctgagcttcgtggaggaggtgttcgagaaccagacccgcctgcccggcggccagtggatctacatgagcgacaactacaccgacgtgaacggcgagaaggtgctgcccaaggacgacatcgagtgccccctgggctggaagtgggaggacgaggagtggagcaccgacctgaaccgcgccgtggacgagcagggctgggagtacagcatcaccatcccccccgagcgcaagcccaagcactgggtgcccgccgagaagatgtactacacccaccgccgccgccgctgggtgcgcctgcgccgccgcgacctgagccagatggaggccctgaagcgccaccgccaggccgaggccgagggcgagggctgggagtacgccagcctgttcggctggaagttccacctggagtaccgcaagaccgacgccttccgccgccgccgctggcgccgccgcatggagcccctggagaagaccggccccgccgccgtgttcgccctggagggcgccctgggcggcgtgatggacgacaagagcgaggacagcatgagcgtgagcaccctgagcttcggcgtgaaccgccccaccatcagctgcatcttcgactacggcaaccgctaccacctgcgctgctacatgtaccaggcccgcgacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggccgctgcatctgccagcccagcctggagcgcatgccccgcctggcctggttccccctgacccgcggcagccagcccagcggcgagctgctggccagcttcgagctgatccagcgcgagaagcccgccatccaccacatccccggcttcgaggtgcaggagaccagccgcatcctggacgagagcgaggacaccgacctgccctacccccccccccagcgcgaggccaacatctacatggtgccccagaacatcaagcccgccctgcagcgcaccgccatcgagatcctggcctggggcctgcgcaacatgaagagctaccagctggccaacatcagcagccccagcctggtggtggagtgcggcggccagaccgtgcagagctgcgtgatccgcaacctgcgcaagaaccccaacttcgacatctgcaccctgttcatggaggtgatgctgccccgcgaggagctgtactgcccccccatcaccgtgaaggtgatcgacaaccgccagttcggccgccgccccgtggtgggccagtgcaccatccgcagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagcgcgagaagtgcggcagctacctggagaaggacttcgacaccctgaaggtgtacgacacccagctggagaacgtggaggccttcgagggcctgagcgacttctgcaacaccttcaagctgtaccgcggcaagacccaggaggagaccgaggaccccagcgtgatcggcgagttcaagggcctgttcaagatctaccccctgcccgaggaccccgccatccccatgcccccccgccagttccaccagctggccgcccagggcccccaggagtgcctggtgcgcatctacatcgtgcgcgccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaaccgcctgctgagcaagttcggcgcccgctgcggcctgccccagacctactgcgtgagcggccccaaccagtggcgcgaccagctgcgccccagccagctgctgcacctgttctgccagcagcaccgcgtgaaggcccccgtgtaccgcaccgaccgcgtgatgttccaggacaaggagtacagcatcgaggagatcgaggccggccgcatccccaacccccacctgggccccgtggaggagcgcctggccctgcacgtgctgcagcagcagggcctggtgcccgagcacgtggagagccgccccctgtacagccccctgcagcccgacatcgagcagggcaagctgcagatgtgggtggacctgttccccaaggccctgggccgccccggcccccccttcaacatcaccccccgccgcgcccgccgcttcttcctgcgctgcatcatctggaacacccgcgacgtgatcctggacgacctgagcctgaccggcgagaagatgagcgacatctacgtgaagggctggatgatcggcttcgaggagcacaagcagaagaccgacgtgcactaccgcagcctgggcggcgagggcaacttcaactggcgcttcatcttccccttcgactacctgcccgccgagcaggtgtgcaccatcgccaagaaggacgccttctggcgcctggacaagaccgagagcaagatccccgcccgcgtggtgttccagatctgggacaacgacaagttcagcttcgacgacttcctgggcagcctgcagctggacctgaaccgcatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagcgccccgccggccagggccgcgacgagcccaacatgaaccccaagctggaggacccccgccgccccgacaccagcttcctgtggttcaccagcccctacaagaccatgaagttcatcctgtggcgccgcttccgctgggccatcatcctgttcatcatcctgttcatcctgctgctgttcctggccatcttcatctacgccttccccaactacgccgccatgaagctggtgaagcccttcagc

SEQ ID NO: 1469 - DNA, 2598 bp, Artificial Sequence
  Description of Artificial Sequence: Synthetic coding sequence
atgttcagcatgcgcatcgtgtgcctggtgctgagcgtggtgggcaccgcctggaccgccgacagcggcgagggcgacttcctggccgagggcggcggcgtgcgcggcccccgcgtggtggagcgccaccagagcgcctgcaaggacagcgactggcccttctgcagcgacgaggactggaactacaagtgccccagcggctgccgcatgaagggcctgatcgacgaggtgaaccaggacttcaccaaccgcatcaacaagctgaagaacagcctgttcgagtaccagaagaacaacaaggacagccacagcctgaccaccaacatcatggagatcctgcgcggcgacttcagcagcgccaacaaccgcgacaacacctacaaccgcgtgagcgaggacctgcgcagccgcatcgaggtgctgaagcgcaaggtgatcgagaaggtgcagcacatccagctgctgcagaagaacgtgcgcgcccagctggtggacatgaagcgcctggaggtggacatcgacatcaagatccgcagctgccgcggcagctgcagccgcgccctggcccgcgaggtggacctgaaggactacgaggaccagcagaagcagctggagcaggtgatcgccaaggacctgctgcccagccgcgaccgccagcacctgcccctgatcaagatgaagcccgtgcccgacctggtgcccggcaacttcaagagccagctgcagaaggtgccccccgagtggaaggccctgaccgacatgccccagatgcgcatggagctggagcgccccggcggcaacgagatcacccgcggcggcagcaccagctacggcaccggcagcgagaccgagagcccccgcaaccccagcagcgccggcagctggaacagcggcagcagcggccccggcagcaccggcaaccgcaaccccggcagcagcggcaccggcggcaccgccacctggaagcccggcagcagcggccccggcagcaccggcagctggaacagcggcagcagcggcaccggcagcaccggcaaccagaaccccggcagcccccgccccggcagcaccggcacctggaaccccggcagcagcgagcgcggcagcgccggccactggaccagcgagagcagcgtgagcggcagcaccggccagtggcacagcgagagcggcagcttccgccccgacagccccggcagcggcaacgcccgccccaacaaccccgactggggcaccttcgaggaggtgagcggcaacgtgagccccggcacccgccgcgagtaccacaccgagaagctggtgaccagcaagggcgacaaggagctgcgcaccggcaaggagaaggtgaccagcggcagcaccaccaccacccgccgcagctgcagcaagaccgtgaccaagaccgtgatcggccccgacggccacaaggaggtgaccaaggaggtggtgaccagcgaggacggcagcgactgccccgaggccatggacctgggcaccctgagcggcatcggcaccctggacggcttccgccaccgccaccccgacgaggccgccttcttcgacaccgccagcaccggcaagaccttccccggcttcttcagccccatgctgggcgagttcgtgagcgagaccgagagccgcggcagcgagagcggcatcttcaccaacaccaaggagagcagcagccaccaccccggcatcgccgagttccccagccgcggcaagagcagcagctacagcaagcagttcaccagcagcaccagctacaaccgcggcgacagcaccttcgagagcaagagctacaagatggccgacgaggccggcagcgaggccgaccacgagggcacccacagcaccaagcgcggccacgccaagagccgccccgtgcgcgactgcgacgacgtgctgcagacccaccccagcggcacccagagcggcatcttcaacatcaagctgcccggcagcagcaagatcttcagcgtgtactgcgaccaggagaccagcctgggcggctggctgctgatccagcagcgcatggacggcagcctgaacttcaaccgcacctggcaggactacaagcgcggcttcggcagcctgaacgacgagggcgagggcgagttctggctgggcaacgactacctgcacctgctgacccagcgcggcagcgtgctgcgcgtggagctggaggactgggccggcaacgaggcctacgccgagtaccacttccgcgtgggcagcgaggccgagggctacgccctgcaggtgagcagctacgagggcaccgccggcgacgccctgatcgagggcagcgtggaggagggcgccgagtacaccagccacaacaacatgcagttcagcaccttcgaccgcgacgccgaccagtgggaggagaactgcgccgaggtgtacggcggcggctggtggtacaacaactgccaggccgccaacctgaacggcatctactaccccggcggcagctacgacccccgcaacaacagcccctacgagatcgagaacggcgtggtgtgggtgagcttccgcggcgccgactacagcctgcgcgccgtgcgcatgaagatccgccccctggtgacccag

SEQ ID NO: 1470 - DNA, 1932 bp, Artificial Sequence
  Description of Artificial Sequence: Synthetic coding sequence
atgttcagcatgcgcatcgtgtgcctggtgctgagcgtggtgggcaccgcctggaccgccgacagcggcgagggcgacttcctggccgagggcggcggcgtgcgcggcccccgcgtggtggagcgccaccagagcgcctgcaaggacagcgactggcccttctgcagcgacgaggactggaactacaagtgccccagcggctgccgcatgaagggcctgatcgacgaggtgaaccaggacttcaccaaccgcatcaacaagctgaagaacagcctgttcgagtaccagaagaacaacaaggacagccacagcctgaccaccaacatcatggagatcctgcgcggcgacttcagcagcgccaacaaccgcgacaacacctacaaccgcgtgagcgaggacctgcgcagccgcatcgaggtgctgaagcgcaaggtgatcgagaaggtgcagcacatccagctgctgcagaagaacgtgcgcgcccagctggtggacatgaagcgcctggaggtggacatcgacatcaagatccgcagctgccgcggcagctgcagccgcgccctggcccgcgaggtggacctgaaggactacgaggaccagcagaagcagctggagcaggtgatcgccaaggacctgctgcccagccgcgaccgccagcacctgcccctgatcaagatgaagcccgtgcccgacctggtgcccggcaacttcaagagccagctgcagaaggtgccccccgagtggaaggccctgaccgacatgccccagatgcgcatggagctggagcgccccggcggcaacgagatcacccgcggcggcagcaccagctacggcaccggcagcgagaccgagagcccccgcaaccccagcagcgccggcagctggaacagcggcagcagcggccccggcagcaccggcaaccgcaaccccggcagcagcggcaccggcggcaccgccacctggaagcccggcagcagcggccccggcagcaccggcagctggaacagcggcagcagcggcaccggcagcaccggcaaccagaaccccggcagcccccgccccggcagcaccggcacctggaaccccggcagcagcgagcgcggcagcgccggccactggaccagcgagagcagcgtgagcggcagcaccggccagtggcacagcgagagcggcagcttccgccccgacagccccggcagcggcaacgcccgccccaacaaccccgactggggcaccttcgaggaggtgagcggcaacgtgagccccggcacccgccgcgagtaccacaccgagaagctggtgaccagcaagggcgacaaggagctgcgcaccggcaaggagaaggtgaccagcggcagcaccaccaccacccgccgcagctgcagcaagaccgtgaccaagaccgtgatcggccccgacggccacaaggaggtgaccaaggaggtggtgaccagcgaggacggcagcgactgccccgaggccatggacctgggcaccctgagcggcatcggcaccctggacggcttccgccaccgccaccccgacgaggccgccttcttcgacaccgccagcaccggcaagaccttccccggcttcttcagccccatgctgggcgagttcgtgagcgagaccgagagccgcggcagcgagagcggcatcttcaccaacaccaaggagagcagcagccaccaccccggcatcgccgagttccccagccgcggcaagagcagcagctacagcaagcagttcaccagcagcaccagctacaaccgcggcgacagcaccttcgagagcaagagctacaagatggccgacgaggccggcagcgaggccgaccacgagggcacccacagcaccaagcgcggccacgccaagagccgccccgtgcgcggcatccacaccagccccctgggcaagcccagcctgagcccc

SEQ ID NO: 1471 - DNA, 1473 bp, Artificial Sequence
  Description of Artificial Sequence: Synthetic coding sequence
atgaagcgcatggtgagctggagcttccacaagctgaagaccatgaagcacctgctgctgctgctgctgtgcgtgttcctggtgaagagccagggcgtgaacgacaacgaggagggcttcttcagcgcccgcggccaccgccccctggacaagaagcgcgaggaggcccccagcctgcgccccgcccccccccccatcagcggcggcggctaccgcgcccgccccgccaaggccgccgccacccagaagaaggtggagcgcaaggcccccgacgccggcggctgcctgcacgccgaccccgacctgggcgtgctgtgccccaccggctgccagctgcaggaggccctgctgcagcaggagcgccccatccgcaacagcgtggacgagctgaacaacaacgtggaggccgtgagccagaccagcagcagcagcttccagtacatgtacctgctgaaggacctgtggcagaagcgccagaagcaggtgaaggacaacgagaacgtggtgaacgagtacagcagcgagctggagaagcaccagctgtacatcgacgagaccgtgaacagcaacatccccaccaacctgcgcgtgctgcgcagcatcctggagaacctgcgcagcaagatccagaagctggagagcgacgtgagcgcccagatggagtactgccgcaccccctgcaccgtgagctgcaacatccccgtggtgagcggcaaggagtgcgaggagatcatccgcaagggcggcgagaccagcgagatgtacctgatccagcccgacagcagcgtgaagccctaccgcgtgtactgcgacatgaacaccgagaacggcggctggaccgtgatccagaaccgccaggacggcagcgtggacttcggccgcaagtgggacccctacaagcagggcttcggcaacgtggccaccaacaccgacggcaagaactactgcggcctgcccggcgagtactggctgggcaacgacaagatcagccagctgacccgcatgggccccaccgagctgctgatcgagatggaggactggaagggcgacaaggtgaaggcccactacggcggcttcaccgtgcagaacgaggccaacaagtaccagatcagcgtgaacaagtaccgcggcaccgccggcaacgccctgatggacggcgccagccagctgatgggcgagaaccgcaccatgaccatccacaacggcatgttcttcagcacctacgaccgcgacaacgacggctggctgaccagcgacccccgcaagcagtgcagcaaggaggacggcggcggctggtggtacaaccgctgccacgccgccaaccccaacggccgctactactggggcggccagtacacctgggacatggccaagcacggcaccgacgacggcgtggtgtggatgaactggaagggcagctggtacagcatgcgcaagatgagcatgaagatccgccccttcttcccccagcag

SEQ ID NO: 1472 - DNA, 1359 bp, Artificial Sequence
  Description of Artificial Sequence: Synthetic coding sequence
atgagctggagcctgcacccccgcaacctgatcctgtacttctacgccctgctgttcctgagcagcacctgcgtggcctacgtggccacccgcgacaactgctgcatcctggacgagcgcttcggcagctactgccccaccacctgcggcatcgccgacttcctgagcacctaccagaccaaggtggacaaggacctgcagagcctggaggacatcctgcaccaggtggagaacaagaccagcgaggtgaagcagctgatcaaggccatccagctgacctacaaccccgacgagagcagcaagcccaacatgatcgacgccgccaccctgaagagccgcaagatgctggaggagatcatgaagtacgaggccagcatcctgacccacgacagcagcatccgctacctgcaggagatctacaacagcaacaaccagaagatcgtgaacctgaaggagaaggtggcccagctggaggcccagtgccaggagccctgcaaggacaccgtgcagatccacgacatcaccggcaaggactgccaggacatcgccaacaagggcgccaagcagagcggcctgtacttcatcaagcccctgaaggccaaccagcagttcctggtgtactgcgagatcgacggcagcggcaacggctggaccgtgttccagaagcgcctggacggcagcgtggacttcaagaagaactggatccagtacaaggagggcttcggccacctgagccccaccggcaccaccgagttctggctgggcaacgagaagatccacctgatcagcacccagagcgccatcccctacgccctgcgcgtggagctggaggactggaacggccgcaccagcaccgccgactacgccatgttcaaggtgggccccgaggccgacaagtaccgcctgacctacgcctacttcgccggcggcgacgccggcgacgccttcgacggcttcgacttcggcgacgaccccagcgacaagttcttcaccagccacaacggcatgcagttcagcacctgggacaacgacaacgacaagttcgagggcaactgcgccgagcaggacggcagcggctggtggatgaacaagtgccacgccggccacctgaacggcgtgtactaccagggcggcacctacagcaaggccagcacccccaacggctacgacaacggcatcatctgggccacctggaagacccgctggtacagcatgaagaagaccaccatgaagatcatccccttcaaccgcctgaccatcggcgagggccagcagcaccacctgggcggcgccaagcaggtgcgccccgagcaccccgccgagaccgagtacgacagcctgtaccccgaggacgacctg

SEQ ID NO: 1473 - DNA, 1311 bp, Artificial Sequence
  Description of Artificial Sequence: Synthetic coding sequence
atgagctggagcctgcacccccgcaacctgatcctgtacttctacgccctgctgttcctgagcagcacctgcgtggcctacgtggccacccgcgacaactgctgcatcctggacgagcgcttcggcagctactgccccaccacctgcggcatcgccgacttcctgagcacctaccagaccaaggtggacaaggacctgcagagcctggaggacatcctgcaccaggtggagaacaagaccagcgaggtgaagcagctgatcaaggccatccagctgacctacaaccccgacgagagcagcaagcccaacatgatcgacgccgccaccctgaagagccgcaagatgctggaggagatcatgaagtacgaggccagcatcctgacccacgacagcagcatccgctacctgcaggagatctacaacagcaacaaccagaagatcgtgaacctgaaggagaaggtggcccagctggaggcccagtgccaggagccctgcaaggacaccgtgcagatccacgacatcaccggcaaggactgccaggacatcgccaacaagggcgccaagcagagcggcctgtacttcatcaagcccctgaaggccaaccagcagttcctggtgtactgcgagatcgacggcagcggcaacggctggaccgtgttccagaagcgcctggacggcagcgtggacttcaagaagaactggatccagtacaaggagggcttcggccacctgagccccaccggcaccaccgagttctggctgggcaacgagaagatccacctgatcagcacccagagcgccatcccctacgccctgcgcgtggagctggaggactggaacggccgcaccagcaccgccgactacgccatgttcaaggtgggccccgaggccgacaagtaccgcctgacctacgcctacttcgccggcggcgacgccggcgacgccttcgacggcttcgacttcggcgacgaccccagcgacaagttcttcaccagccacaacggcatgcagttcagcacctgggacaacgacaacgacaagttcgagggcaactgcgccgagcaggacggcagcggctggtggatgaacaagtgccacgccggccacctgaacggcgtgtactaccagggcggcacctacagcaaggccagcacccccaacggctacgacaacggcatcatctgggccacctggaagacccgctggtacagcatgaagaagaccaccatgaagatcatccccttcaaccgcctgaccatcggcgagggccagcagcaccacctgggcggcgccaagcaggccggcgacgtg

SEQ ID NO: 1474 - DNA, 627 bp, Artificial Sequence
  Description of Artificial Sequence: Synthetic coding sequence
atggacagcgacgagaccggcttcgagcacagcggcctgtgggtgagcgtgctggccggcctgctgctgggcgcctgccaggcccaccccatccccgacagcagccccctgctgcagttcggcggccaggtgcgccagcgctacctgtacaccgacgacgcccagcagaccgaggcccacctggagatccgcgaggacggcaccgtgggcggcgccgccgaccagagccccgagagcctgctgcagctgaaggccctgaagcccggcgtgatccagatcctgggcgtgaagaccagccgcttcctgtgccagcgccccgacggcgccctgtacggcagcctgcacttcgaccccgaggcctgcagcttccgcgagctgctgctggaggacggctacaacgtgtaccagagcgaggcccacggcctgcccctgcacctgcccggcaacaagagcccccaccgcgaccccgccccccgcggccccgcccgcttcctgcccctgcccggcctgccccccgccctgcccgagccccccggcatcctggccccccagccccccgacgtgggcagcagcgaccccctgagcatggtgggccccagccagggccgcagccccagctacgccagc

SEQ ID NO: 1475 - DNA, 1257 bp, Artificial Sequence
  Description of Artificial Sequence: Synthetic coding sequence
atgagcttcatccccgtggccgaggacagcgacttccccatccacaacctgccctacggcgtgttcagcacccgcggcgacccccgcccccgcatcggcgtggccatcggcgaccagatcctggacctgagcatcatcaagcacctgttcaccggccccgtgctgagcaagcaccaggacgtgttcaaccagcccaccctgaacagcttcatgggcctgggccaggccgcctggaaggaggcccgcgtgttcctgcagaacctgctgagcgtgagccaggcccgcctgcgcgacgacaccgagctgcgcaagtgcgccttcatcagccaggccagcgccaccatgcacctgcccgccaccatcggcgactacaccgacttctacagcagccgccagcacgccaccaacgtgggcatcatgttccgcgacaaggagaacgccctgatgcccaactggctgcacctgcccgtgggctaccacggccgcgccagcagcgtggtggtgagcggcacccccatccgccgccccatgggccagatgaagcccgacgacagcaagccccccgtgtacggcgcctgcaagctgctggacatggagctggagatggccttcttcgtgggccccggcaaccgcctgggcgagcccatccccatcagcaaggcccacgagcacatcttcggcatggtgctgatgaacgactggagcgcccgcgacatccagaagtgggagtacgtgcccctgggccccttcctgggcaagagcttcggcaccaccgtgagcccctgggtggtgcccatggacgccctgatgcccttcgccgtgcccaaccccaagcaggacccccgccccctgccctacctgtgccacgacgagccctacaccttcgacatcaacctgagcgtgaacctgaagggcgagggcatgagccaggccgccaccatctgcaagagcaacttcaagtacatgtactggaccatgctgcagcagctgacccaccacagcgtgaacggctgcaacctgcgccccggcgacctgctggccagcggcaccatcagcggccccgagcccgagaacttcggcagcatgctggagctgagctggaagggcaccaagcccatcgacctgggcaacggccagacccgcaagttcctgctggacggcgacgaggtgatcatcaccggctactgccagggcgacggctaccgcatcggcttcggccagtgcgccggcaaggtgctgcccgccctgctgcccagc

SEQ ID NO: 1476 - DNA, 1566 bp, Artificial Sequence
  Description of Artificial Sequence: Synthetic coding sequence
atggccgccgtggtggccgccacccgctggtggcagctgctgctggtgctgagcgccgccggcatgggcgccagcggcgccccccagccccccaacatcctgctgctgctgatggacgacatgggctggggcgacctgggcgtgtacggcgagcccagccgcgagacccccaacctggaccgcatggccgccgagggcctgctgttccccaacttctacagcgccaaccccctgtgcagccccagccgcgccgccctgctgaccggccgcctgcccatccgcaacggcttctacaccaccaacgcccacgcccgcaacgcctacaccccccaggagatcgtgggcggcatccccgacagcgagcagctgctgcccgagctgctgaagaaggccggctacgtgagcaagatcgtgggcaagtggcacctgggccaccgcccccagttccaccccctgaagcacggcttcgacgagtggttcggcagccccaactgccacttcggcccctacgacaacaaggcccgccccaacatccccgtgtaccgcgactgggagatggtgggccgctactacgaggagttccccatcaacctgaagaccggcgaggccaacctgacccagatctacctgcaggaggccctggacttcatcaagcgccaggcccgccaccaccccttcttcctgtactgggccgtggacgccacccacgcccccgtgtacgccagcaagcccttcctgggcaccagccagcgcggccgctacggcgacgccgtgcgcgagatcgacgacagcatcggcaagatcctggagctgctgcaggacctgcacgtggccgacaacaccttcgtgttcttcaccagcgacaacggcgccgccctgatcagcgcccccgagcagggcggcagcaacggccccttcctgtgcggcaagcagaccaccttcgagggcggcatgcgcgagcccgccctggcctggtggcccggccacgtgaccgccggccaggtgagccaccagctgggcagcatcatggacctgttcaccaccagcctggccctggccggcctgaccccccccagcgaccgcgccatcgacggcctgaacctgctgcccaccctgctgcagggccgcctgatggaccgccccatcttctactaccgcggcgacaccctgatggccgccaccctgggccagcacaaggcccacttctggacctggaccaacagctgggagaacttccgccagggcatcgacttctgccccggccagaacgtgagcggcgtgaccacccacaacctggaggaccacaccaagctgcccctgatcttccacctgggccgcgaccccggcgagcgcttccccctgagcttcgccagcgccgagtaccaggaggccctgagccgcatcaccagcgtggtgcagcagcaccaggaggccctggtgcccgcccagccccagctgaacgtgtgcaactgggccgtgatgaactgggccccccccggctgcgagaagctgggcaagtgcctgaccccccccgagagcatccccaagaagtgcctgtggagccac

SEQ ID NO: 1477 - DNA, 1341 bp, Artificial Sequence
  Description of Artificial Sequence: Synthetic coding sequence
atggccgccgtggtggccgccacccgctggtggcagctgctgctggtgctgagcgccgccggcatgggcgccagcggcgcccccggccagcgcgcctacaccccccaggagatcgtgggcggcatccccgacagcgagcagctgctgcccgagctgctgaagaaggccggctacgtgagcaagatcgtgggcaagtggcacctgggccaccgcccccagttccaccccctgaagcacggcttcgacgagtggttcggcagccccaactgccacttcggcccctacgacaacaaggcccgccccaacatccccgtgtaccgcgactgggagatggtgggccgctactacgaggagttccccatcaacctgaagaccggcgaggccaacctgacccagatctacctgcaggaggccctggacttcatcaagcgccaggcccgccaccaccccttcttcctgtactgggccgtggacgccacccacgcccccgtgtacgccagcaagcccttcctgggcaccagccagcgcggccgctacggcgacgccgtgcgcgagatcgacgacagcatcggcaagatcctggagctgctgcaggacctgcacgtggccgacaacaccttcgtgttcttcaccagcgacaacggcgccgccctgatcagcgcccccgagcagggcggcagcaacggccccttcctgtgcggcaagcagaccaccttcgagggcggcatgcgcgagcccgccctggcctggtggcccggccacgtgaccgccggccaggtgagccaccagctgggcagcatcatggacctgttcaccaccagcctggccctggccggcctgaccccccccagcgaccgcgccatcgacggcctgaacctgctgcccaccctgctgcagggccgcctgatggaccgccccatcttctactaccgcggcgacaccctgatggccgccaccctgggccagcacaaggcccacttctggacctggaccaacagctgggagaacttccgccagggcatcgacttctgccccggccagaacgtgagcggcgtgaccacccacaacctggaggaccacaccaagctgcccctgatcttccacctgggccgcgaccccggcgagcgcttccccctgagcttcgccagcgccgagtaccaggaggccctgagccgcatcaccagcgtggtgcagcagcaccaggaggccctggtgcccgcccagccccagctgaacgtgtgcaactgggccgtgatgaactgggccccccccggctgcgagaagctgggcaagtgcctgaccccccccgagagcatccccaagaagtgcctgtggagccac

SEQ ID NO: 1478 - DNA, 2106 bp, Artificial Sequence
  Description of Artificial Sequence: Synthetic coding sequence
atggccgcccccatgacccccgccgcccgccccgaggactacgaggccgccctgaacgccgccctggccgacgtgcccgagctggcccgcctgctggagatcgacccctacctgaagccctacgccgtggacttccagcgccgctacaagcagttcagccagatcctgaagaacatcggcgagaacgagggcggcatcgacaagttcagccgcggctacgagagcttcggcgtgcaccgctgcgccgacggcggcctgtactgcaaggagtgggcccccggcgccgagggcgtgttcctgaccggcgacttcaacggctggaaccccttcagctacccctacaagaagctggactacggcaagtgggagctgtacatcccccccaagcagaacaagagcgtgctggtgccccacggcagcaagctgaaggtggtgatcaccagcaagagcggcgagatcctgtaccgcatcagcccctgggccaagtacgtggtgcgcgagggcgacaacgtgaactacgactggatccactgggaccccgagcacagctacgagttcaagcacagccgccccaagaagccccgcagcctgcgcatctacgagagccacgtgggcatcagcagccacgagggcaaggtggccagctacaagcacttcacctgcaacgtgctgccccgcatcaagggcctgggctacaactgcatccagctgatggccatcatggagcacgcctactacgccagcttcggctaccagatcaccagcttcttcgccgccagcagccgctacggcacccccgaggagctgcaggagctggtggacaccgcccacagcatgggcatcatcgtgctgctggacgtggtgcacagccacgccagcaagaacagcgccgacggcctgaacatgttcgacggcaccgacagctgctacttccacagcggcccccgcggcacccacgacctgtgggacagccgcctgttcgcctacagcagctgggagatcctgcgcttcctgctgagcaacatccgctggtggctggaggagtaccgcttcgacggcttccgcttcgacggcgtgaccagcatgctgtaccaccaccacggcgtgggccagggcttcagcggcgactacagcgagtacttcggcctgcaggtggacgaggacgccctgacctacctgatgctggccaaccacctggtgcacaccctgtgccccgacagcatcaccatcgccgaggacgtgagcggcatgcccgccctgtgcagccccatcagccagggcggcggcggcttcgactaccgcctggccatggccatccccgacaagtggatccagctgctgaaggagttcaaggacgaggactggaacatgggcgacatcgtgtacaccctgaccaaccgccgctacctggagaagtgcatcgcctacgccgagagccacgaccaggccctggtgggcgacaagagcctggccttctggctgatggacgccgagatgtacaccaacatgagcgtgctgacccccttcacccccgtgatcgaccgcggcatccagctgcacaagatgatccgcctgatcacccacggcctgggcggcgagggctacctgaacttcatgggcaacgagttcggccaccccgagtggctggacttcccccgcaagggcaacaacgagagctaccactacgcccgccgccagttccacctgaccgacgacgacctgctgcgctacaagttcctgaacaacttcgaccgcgacatgaaccgcctggaggagcgctacggctggctggccgccccccaggcctacgtgagcgagaagcacgagggcaacaagatcatcgccttcgagcgcgccggcctgctgttcatcttcaacttccaccccagcaagagctacaccgactaccgcgtgggcaccgccctgcccggcaagttcaagatcgtgctggacagcgacgccgccgagtacggcggccaccagcgcctggaccacagcaccgacttcttcagcgaggccttcgagcacaacggccgcccctacagcctgctggtgtacatccccagccgcgtggccctgatcctgcagaacgtggacctgcccaac

SEQ ID NO: 1479 - DNA, 225 bp, Artificial Sequence
  Description of Artificial Sequence: Synthetic coding sequence
atgggccgcgactaccgcacctgcctgaccatcgtgcagaagctgaagaagatggtggacaagcccacccagcgcagcgtgagcaacgccgccacccgcgtgtgccgcaccggccgcagccgctggcgcgacgtgtgccgcaacttcatgcgccgctaccagagccgcgtgacccagggcctggtggccggcgagaccgcccagcagatctgcgaggacctgcgc

SEQ ID NO: 1480 - DNA, 288 bp, Artificial Sequence
  Description of Artificial Sequence: Synthetic coding sequence
atggccacctgggccctgctgctgctggccgccatgctgctgggcaaccccggcctggtgttcagcggccgcgactaccgcacctgcctgaccatcgtgcagaagctgaagaagatggtggacaagcccacccagcgcagcgtgagcaacgccgccacccgcgtgtgccgcaccggccgcagccgctggcgcgacgtgtgccgcaacttcatgcgccgctaccagagccgcgtgacccagggcctggtggccggcgagaccgcccagcagatctgcgaggacctgcgc

SEQ ID NO: 1481 - DNA, 1278 bp, Artificial Sequence
  Description of Artificial Sequence: Synthetic coding sequence
atgggcgagcccggccagagccccagcccccgcagcagccacggcagcccccccaccctgagcaccctgaccctgctgctgctgctgtgcggccacgcccacagccagtgcaagatcctgcgctgcaacgccgagtacgtgagcagcaccctgagcctgcgcggcggcggcagcagcggcgccctgcgcggcggcggcggcggcggccgcggcggcggcgtgggcagcggcggcctgtgccgcgccctgcgcagctacgccctgtgcacccgccgcaccgcccgcacctgccgcggcgacctggccttccacagcgccgtgcacggcatcgaggacctgatgatccagcacaactgcagccgccagggccccaccgcccccccccccccccgcggccccgccctgcccggcgccggcagcggcctgcccgcccccgacccctgcgactacgagggccgcttcagccgcctgcacggccgcccccccggcttcctgcactgcgccagcttcggcgacccccacgtgcgcagcttccaccaccacttccacacctgccgcgtgcagggcgcctggcccctgctggacaacgacttcctgttcgtgcaggccaccagcagccccatggccctgggcgccaacgccaccgccacccgcaagctgaccatcatcttcaagaacatgcaggagtgcatcgaccagaaggtgtaccaggccgaggtggacaacctgcccgtggccttcgaggacggcagcatcaacggcggcgaccgccccggcggcagcagcctgagcatccagaccgccaaccccggcaaccacgtggagatccaggccgcctacatcggcaccaccatcatcatccgccagaccgccggccagctgagcttcagcatcaaggtggccgaggacgtggccatggccttcagcgccgagcaggacctgcagctgtgcgtgggcggctgcccccccagccagcgcctgagccgcagcgagcgcaaccgccgcggcgccatcaccatcgacaccgcccgccgcctgtgcaaggagggcctgcccgtggaggacgcctacttccacagctgcgtgttcgacgtgctgatcagcggcgaccccaacttcaccgtggccgcccaggccgccctggaggacgcccgcgccttcctgcccgacctggagaagctgcacctgttccccagcgacgccggcgtgcccctgagcagcgccaccctgctggcccccctgctgagcggcctgttcgtgctgtggctgtgcatccag

SEQ ID NO: 1482 - DNA, 939 bp, Artificial Sequence
  Description of Artificial Sequence: Synthetic coding sequence
atgatccagcacaactgcagccgccagggccccaccgcccccccccccccccgcggccccgccctgcccggcgccggcagcggcctgcccgcccccgacccctgcgactacgagggccgcttcagccgcctgcacggccgcccccccggcttcctgcactgcgccagcttcggcgacccccacgtgcgcagcttccaccaccacttccacacctgccgcgtgcagggcgcctggcccctgctggacaacgacttcctgttcgtgcaggccaccagcagccccatggccctgggcgccaacgccaccgccacccgcaagctgaccatcatcttcaagaacatgcaggagtgcatcgaccagaaggtgtaccaggccgaggtggacaacctgcccgtggccttcgaggacggcagcatcaacggcggcgaccgccccggcggcagcagcctgagcatccagaccgccaaccccggcaaccacgtggagatccaggccgcctacatcggcaccaccatcatcatccgccagaccgccggccagctgagcttcagcatcaaggtggccgaggacgtggccatggccttcagcgccgagcaggacctgcagctgtgcgtgggcggctgcccccccagccagcgcctgagccgcagcgagcgcaaccgccgcggcgccatcaccatcgacaccgcccgccgcctgtgcaaggagggcctgcccgtggaggacgcctacttccacagctgcgtgttcgacgtgctgatcagcggcgaccccaacttcaccgtggccgcccaggccgccctggaggacgcccgcgccttcctgcccgacctggagaagctgcacctgttccccagcgacgccggcgtgcccctgagcagcgccaccctgctggcccccctgctgagcggcctgttcgtgctgtggctgtgcatccag

SEQ ID NO: 1483 - DNA, 279 bp, Artificial Sequence
  Description of Artificial Sequence: Synthetic coding sequence
atgggcgagcccggccagagccccagcccccgcagcagccacggcagcccccccaccctgagcaccctgaccctgctgctgctgctgtgcggccacgcccacagccagtgcaagatcctgcgctgcaacgccgagtacgtgagcagcaccctgagcctgcgcggcggcggcagcagcggcgccctgcgcggcggcggcggcggcggccgcggcggcggcgtgggcagcggcggcctgtgccgcgccctgcgcagctacgccctgtgcacccgccgcacc

SEQ ID NO: 1484 - DNA, 600 bp, Artificial Sequence
  Description of Artificial Sequence: Synthetic coding sequence
atgcaggagtgcatcgaccagaaggtgtaccaggccgaggtggacaacctgcccgtggccttcgaggacggcagcatcaacggcggcgaccgccccggcggcagcagcctgagcatccagaccgccaaccccggcaaccacgtggagatccaggccgcctacatcggcaccaccatcatcatccgccagaccgccggccagctgagcttcagcatcaaggtggccgaggacgtggccatggccttcagcgccgagcaggacctgcagctgtgcgtgggcggctgcccccccagccagcgcctgagccgcagcgagcgcaaccgccgcggcgccatcaccatcgacaccgcccgccgcctgtgcaaggagggcctgcccgtggaggacgcctacttccacagctgcgtgttcgacgtgctgatcagcggcgaccccaacttcaccgtggccgcccaggccgccctggaggacgcccgcgccttcctgcccgacctggagaagctgcacctgttccccagcgacgccggcgtgcccctgagcagcgccaccctgctggcccccctgctgagcggcctgttcgtgctgtggctgtgcatccag

SEQ ID NO: 1485 - DNA, 252 bp, Artificial Sequence
  Description of Artificial Sequence: Synthetic coding sequence
atggccctgagcagccagatctgggccgcctgcctgctgctgctgctgctgctggccagcctgaccagcggcagcgtgttcccccagcagaccggccagctggccgagctgcagccccaggaccgcgccggcgcccgcgccagctggatgcccatgttccagcgccgccgccgccgcgacacccacttccccatctgcatcttctgctgcggctgctgccaccgcagcaagtgcggcatgtgctgcaagacc

SEQ ID NO: 1486 - DNA, 654 bp, Artificial Sequence
  Description of Artificial Sequence: Synthetic coding sequence
atggccacccgcagccccggcgtggtgatcagcgacgacgagcccggctacgacctggacctgttctgcatccccaaccactacgccgaggacctggagcgcgtgttcatcccccacggcctgatcatggaccgcaccgagcgcctggcccgcgacgtgatgaaggagatgggcggccaccacatcgtggccctgtgcgtgctgaagggcggctacaagttcttcgccgacctgctggactacatcaaggccctgaaccgcaacagcgaccgcagcatccccatgaccgtggacttcatccgcctgaagagctactgcaacgaccagagcaccggcgacatcaaggtgatcggcggcgacgacctgagcaccctgaccggcaagaacgtgctgatcgtggaggacatcatcgacaccggcaagaccatgcagaccctgctgagcctggtgcgccagtacaaccccaagatggtgaaggtggccagcctgctggtgaagcgcaccccccgcagcgtgggctacaagcccgacttcgtgggcttcgagatccccgacaagttcgtggtgggctacgccctggactacaacgagtacttccgcgacctgaaccacgtgtgcgtgatcagcgagaccggcaaggccaagtacaaggcc

SEQ ID NO: 1487 - DNA, 534 bp, Artificial Sequence
  Description of Artificial Sequence: Synthetic coding sequence
atgcacagcagcgccctgctgtgctgcctggtgctgctgaccggcgtgcgcgccagccccggccagggcacccagagcgagaacagctgcacccacttccccggcaacctgcccaacatgctgcgcgacctgcgcgacgccttcagccgcgtgaagaccttcttccagatgaaggaccagctggacaacctgctgctgaaggagagcctgctggaggacttcaagggctacctgggctgccaggccctgagcgagatgatccagttctacctggaggaggtgatgccccaggccgagaaccaggaccccgacatcaaggcccacgtgaacagcctgggcgagaacctgaagaccctgcgcctgcgcctgcgccgctgccaccgcttcctgccctgcgagaacaagagcaaggccgtggagcaggtgaagaacgccttcaacaagctgcaggagaagggcatctacaaggccatgagcgagttcgacatcttcatcaactacatcgaggcctacatgaccatgaagatccgcaac

SEQ ID NO: 1488 - DNA, 531 bp, Artificial Sequence
  Description of Artificial Sequence: Synthetic coding sequence
atgttccacgtgagcttccgctacatcttcggcctgccccccctgatcctggtgctgctgcccgtggccagcagcgactgcgacatcgagggcaaggacggcaagcagtacgagagcgtgctgatggtgagcatcgaccagctgctggacagcatgaaggagatcggcagcaactgcctgaacaacgagttcaacttcttcaagcgccacatctgcgacgccaacaaggagggcatgttcctgttccgcgccgcccgcaagctgcgccagttcctgaagatgaacagcaccggcgacttcgacctgcacctgctgaaggtgagcgagggcaccaccatcctgctgaactgcaccggccaggtgaagggccgcaagcccgccgccctgggcgaggcccagcccaccaagagcctggaggagaacaagagcctgaaggagcagaagaagctgaacgacctgtgcttcctgaagcgcctgctgcaggagatcaagacctgctggaacaagatcctgatgggcaccaaggagcac

SEQ ID NO: 1489 - DNA, 213 bp, Artificial Sequence
  Description of Artificial Sequence: Synthetic coding sequence
atgttccacgtgagcttccgctacatcttcggcctgccccccctgatcctggtgctgctgcccgtggccagcagcgactgcgacatcgagggcaaggacggcaagcagtacgagagcgtgctgatggtgagcatcgaccagctgctgaaccagccctacaagaagaaggagaagcgcaccgagcgcaagcagcagagcgccatgagcaacaac

SEQ ID NO: 1490 - DNA, 111 bp, Artificial Sequence
  Description of Artificial Sequence: Synthetic coding sequence
atgttccacgtgagcttccgctacatcttcggcctgccccccctgatcctggtgctgctgcccgtggccagcagcgactgcgacatcgagggccagcacgagcgcaactgg

SEQ ID NO: 1491 - DNA, 399 bp, Artificial Sequence
  Description of Artificial Sequence: Synthetic coding sequence
atgttccacgtgagcttccgctacatcttcggcctgccccccctgatcctggtgctgctgcccgtggccagcagcgactgcgacatcgagggcaaggacggcaagcagtacgagagcgtgctgatggtgagcatcgaccagctgctggacagcatgaaggagatcggcagcaactgcctgaacaacgagttcaacttcttcaagcgccacatctgcgacgccaacaaggtgaagggccgcaagcccgccgccctgggcgaggcccagcccaccaagagcctggaggagaacaagagcctgaaggagcagaagaagctgaacgacctgtgcttcctgaagcgcctgctgcaggagatcaagacctgctggaacaagatcctgatgggcaccaaggagcac

SEQ ID NO: 1492 - DNA, 192 bp, Artificial Sequence
  Description of Artificial Sequence: Synthetic coding sequence
atgaaggagatcggcagcaactgcctgaacaacgagttcaacttcttcaagcgccacatctgcgacgccaacaaggaggagaacaagagcctgaaggagcagaagaagctgaacgacctgtgcttcctgaagcgcctgctgcaggagatcaagacctgctggaacaagatcctgatgggcaccaaggagcac

SEQ ID NO: 1493 - DNA, 3036 bp, Artificial Sequence
  Description of Artificial Sequence: Synthetic coding sequence
atgcccgccagcgcccccccccgccgcccccgcccccccccccccagcctgagcctgctgctggtgctgctgggcctgggcggccgccgcctgcgcgccgagcccggcgacggcgcccagacctgggcccgcttcagccgcccccccgcccccgaggccgccggcctgttccagggcaccttccccgacggcttcctgtgggccgtgggcagcgccgcctaccagaccgagggcggctggcagcagcacggcaagggcgccagcatctgggacaccttcacccaccaccccctggccccccccggcgacagccgcaacgccagcctgcccctgggcgcccccagccccctgcagcccgccaccggcgacgtggccagcgacagctacaacaacgtgttccgcgacaccgaggccctgcgcgagctgggcgtgacccactaccgcttcagcatcagctgggcccgcgtgctgcccaacggcagcgccggcgtgcccaaccgcgagggcctgcgctactaccgccgcctgctggagcgcctgcgcgagctgggcgtgcagcccgtggtgaccctgtaccactgggacctgccccagcgcctgcaggacgcctacggcggctgggccaaccgcgccctggccgaccacttccgcgactacgccgagctgtgcttccgccacttcggcggccaggtgaagtactggatcaccatcgacaacccctacgtggtggcctggcacggctacgccaccggccgcctggcccccggcatccgcggcagcccccgcctgggctacctggtggcccacaacctgctgctggcccacgccaaggtgtggcacctgtacaacaccagcttccgccccacccagggcggccaggtgagcatcgccctgagcagccactggatcaacccccgccgcatgaccgaccacagcatcaaggagtgccagaagagcctggacttcgtgctgggctggttcgccaagcccgtgttcatcgacggcgactaccccgagagcatgaagaacaacctgagcagcatcctgcccgacttcaccgagagcgagaagaagttcatcaagggcaccgccgacttcttcgccctgtgcttcggccccaccctgagcttccagctgctggacccccacatgaagttccgccagctggagagccccaacctgcgccagctgctgagctggatcgacctggagttcaaccacccccagatcttcatcgtggagaacggctggttcgtgagcggcaccaccaagcgcgacgacgccaagtacatgtactacctgaagaagttcatcatggagaccctgaaggccatcaagctggacggcgtggacgtgatcggctacaccgcctggagcctgatggacggcttcgagtggcaccgcggctacagcatccgccgcggcctgttctacgtggacttcctgagccaggacaagatgctgctgcccaagagcagcgccctgttctaccagaagctgatcgagaagaacggcttcccccccctgcccgagaaccagcccctggagggcaccttcccctgcgacttcgcctggggcgtggtggacaactacatccaggtggacaccaccctgagccagttcaccgacctgaacgtgtacctgtgggacgtgcaccacagcaagcgcctgatcaaggtggacggcgtggtgaccaagaagcgcaagagctactgcgtggacttcgccgccatccagccccagatcgccctgctgcaggagatgcacgtgacccacttccgcttcagcctggactgggccctgatcctgcccctgggcaaccagagccaggtgaaccacaccatcctgcagtactaccgctgcatggccagcgagctggtgcgcgtgaacatcacccccgtggtggccctgtggcagcccatggcccccaaccagggcctgccccgcctgctggcccgccagggcgcctgggagaacccctacaccgccctggccttcgccgagtacgcccgcctgtgcttccaggagctgggccaccacgtgaagctgtggatcaccatgaacgagccctacacccgcaacatgacctacagcgccggccacaacctgctgaaggcccacgccctggcctggcacgtgtacaacgagaagttccgccacgcccagaacggcaagatcagcatcgccctgcaggccgactggatcgagcccgcctgccccttcagccagaaggacaaggaggtggccgagcgcgtgctggagttcgacatcggctggctggccgagcccatcttcggcagcggcgactacccctgggtgatgcgcgactggctgaaccagcgcaacaacttcctgctgccctacttcaccgaggacgagaagaagctgatccagggcaccttcgacttcctggccctgagccactacaccaccatcctggtggacagcgagaaggaggaccccatcaagtacaacgactacctggaggtgcaggagatgaccgacatcacctggctgaacagccccagccaggtggccgtggtgccctggggcctgcgcaaggtgctgaactggctgaagttcaagtacggcgacctgcccatgtacatcatcagcaacggcatcgacgacggcctgcacgccgaggacgaccagctgcgcgtgtactacatgcagaactacatcaacgaggccctgaaggcccacatcctggacggcatcaacctgtgcggctacttcgcctacagcttcaacgaccgcaccgccccccgcttcggcctgtaccgctacgccgccgaccagttcgagcccaaggccagcatgaagcactaccgcaagatcatcgacagcaacggcttccccggccccgagaccctggagcgcttctgccccgaggagttcaccgtgtgcaccgagtgcagcttcttccacacccgcaagagcctgctggccttcatcgccttcctgttcttcgccagcatcatcagcctgagcctgatcttctactacagcaagaagggccgccgcagctacaag

SEQ ID NO: 1494 - DNA, 726 bp, Artificial Sequence
  Description of Artificial Sequence: Synthetic coding sequence
atgaccgaccacagcatcaaggagtgccagaagagcctggacttcgtgctgggctggttcgccaagcccgtgttcatcgacggcgactaccccgagagcatgaagaacaacctgagcagcatcctgcccgacttcaccgagagcgagaagaagttcatcaagggcaccgccgacttcttcgccctgtgcttcggccccaccctgagcttccagctgctggacccccacatgaagttccgccagctggagagccccaacctgcgccagctgctgagctggatcgacctggagttcaaccacccccagatcttcatcgtggagaacggctggttcgtgagcggcaccaccaagcgcgacgacgccaagtacatgtactacctgaagaagttcatcatggagaccctgaaggccatcaagctggacggcgtggacgtgatcggctacaccgcctggagcctgatggacggcttcgagtggcaccgcggctacagcatccgccgcggcctgttctacgtggacttcctgagccaggacaagatgctgctgcccaagagcagcgccctgttctaccagaagctgatcgagaagaacggcttcccccccctgcccgagaaccagcccctggagggcaccttcccctgcgacttcgcctggggcgtggtggacaactacatccaggtgagccagctgaccaagcccatcagcagcctgaccaagccctaccac

SEQ ID NO: 1495 - DNA, 1320 bp, Artificial Sequence
  Description of Artificial Sequence: Synthetic coding sequence
atgggcccccccggcagcccctggcagtgggtgaccctgctgctgggcctgctgctgccccccgccgcccccttctggctgctgaacgtgctgttccccccccacaccacccccaaggccgagctgagcaaccacacccgccccgtgatcctggtgcccggctgcctgggcaaccagctggaggccaagctggacaagcccgacgtggtgaactggatgtgctaccgcaagaccgaggacttcttcaccatctggctggacctgaacatgttcctgcccctgggcgtggactgctggatcgacaacacccgcgtggtgtacaaccgcagcagcggcctggtgagcaacgcccccggcgtgcagatccgcgtgcccggcttcggcaagacctacagcgtggagtacctggacagcagcaagctggccggctacctgcacaccctggtgcagaacctggtgaacaacggctacgtgcgcgacgagaccgtgcgcgccgccccctacgactggcgcctggagcccggccagcaggaggagtactaccgcaagctggccggcctggtggaggagatgcacgccgcctacggcaagcccgtgttcctgatcggccacagcctgggctgcctgcacctgctgtacttcctgctgcgccagccccaggcctggaaggaccgcttcatcgacggcttcatcagcctgggcgccccctggggcggcagcatcaagcccatgctggtgctggccagcggcgacaaccagggcatccccatcatgagcagcatcaagctgaaggaggagcagcgcatcaccaccaccagcccctggatgttccccagccgcatggcctggcccgaggaccacgtgttcatcagcacccccagcttcaactacaccggccgcgacttccagcgcttcttcgccgacctgcacttcgaggagggctggtacatgtggctgcagagccgcgacctgctggccggcctgcccgcccccggcgtggaggtgtactgcctgtacggcgtgggcctgcccaccccccgcacctacatctacgaccacggcttcccctacaccgaccccgtgggcgtgctgtacgaggacggcgacgacaccgtggccacccgcagcaccgagctgtgcggcctgtggcagggccgccagccccagcccgtgcacctgctgcccctgcacggcatccagcacctgaacatggtgttcagcaacctgaccctggagcacatcaacgccatcctgctgggcgcctaccgccagggcccccccgccagccccaccgccagccccgagccccccccccccgag

SEQ ID NO: 1496 - DNA, 657 bp, Artificial Sequence
  Description of Artificial Sequence: Synthetic coding sequence
atgaagatgcgcttcctgggcctggtggtgtgcctggtgctgtggaccctgcacagcgagggcagcggcggcaagctgaccgccgtggaccccgagaccaacatgaacgtgagcgagatcatcagctactggggcttccccagcgaggagtacctggtggagaccgaggacggctacatcctgtgcctgaaccgcatcccccacggccgcaagaaccacagcgacaagggccccaagcccgtggtgttcctgcagcacggcctgctggccgacagcagcaactgggtgaccaacctggccaacagcagcctgggcttcatcctggccgacgccggcttcgacgtgtggatgggcaacagccgcggcaacacctggagccgcaagcacaagaccctgagcgtgagccaggacgagttctgggccttcagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagcgcatcaagatgttcttcgccctgggccccgtggccagcgtggccttctgcaccagccccatggccaagctgggccgcctg

SEQ ID NO: 1497 - DNA, 1197 bp, Artificial Sequence
  Description of Artificial Sequence: Synthetic coding sequence
atgaagatgcgcttcctgggcctggtggtgtgcctggtgctgtggaccctgcacagcgagggcagcggcggcaagctgaccgccgtggaccccgagaccaacatgaacgtgagcgagatcatcagctactggggcttccccagcgaggagtacctggtggagaccgaggacggctacatcctgtgcctgaaccgcatcccccacggccgcaagaaccacagcgacaagggccccaagcccgtggtgttcctgcagcacggcctgctggccgacagcagcaactgggtgaccaacctggccaacagcagcctgggcttcatcctggccgacgccggcttcgacgtgtggatgggcaacagccgcggcaacacctggagccgcaagcacaagaccctgagcgtgagccaggacgagttctgggccttcagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagcgcatcaagatgttcttcgccctgggccccgtggccagcgtggccttctgcaccagccccatggccaagctgggccgcctgcccgaccacctgatcaaggacctgttcggcgacaaggagttcctgccccagagcgccttcctgaagtggctgggcacccacgtgtgcacccacgtgatcctgaaggagctgtgcggcaacctgtgcttcctgctgtgcggcttcaacgagcgcaacctgaacatgagccgcgtggacgtgtacaccacccacagccccgccggcaccagcgtgcagaacatgctgcactggagccaggccgtgaagttccagaagttccaggccttcgactggggcagcagcgccaagaactacttccactacaaccagagctacccccccacctacaacgtgaaggacatgctggtgcccaccgccgtgtggagcggcggccacgactggctggccgacgtgtacgacgtgaacatcctgctgacccagatcaccaacctggtgttccacgagagcatccccgagtgggagcacctggacttcatctggggcctggacgccccctggcgcctgtacaacaagatcatcaacctgatgcgcaagtaccag

SEQ ID NO: 1498 - DNA, 1029 bp, Artificial Sequence
  Description of Artificial Sequence: Synthetic coding sequence
atggcctgcctggagttcgtgcccttcgacgtgcagatgtgcctggagttcctgcccagcggccccaagcccgtggtgttcctgcagcacggcctgctggccgacagcagcaactgggtgaccaacctggccaacagcagcctgggcttcatcctggccgacgccggcttcgacgtgtggatgggcaacagccgcggcaacacctggagccgcaagcacaagaccctgagcgtgagccaggacgagttctgggccttcagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagcgcatcaagatgttcttcgccctgggccccgtggccagcgtggccttctgcaccagccccatggccaagctgggccgcctgcccgaccacctgatcaaggacctgttcggcgacaaggagttcctgccccagagcgccttcctgaagtggctgggcacccacgtgtgcacccacgtgatcctgaaggagctgtgcggcaacctgtgcttcctgctgtgcggcttcaacgagcgcaacctgaacatgagccgcgtggacgtgtacaccacccacagccccgccggcaccagcgtgcagaacatgctgcactggagccaggccgtgaagttccagaagttccaggccttcgactggggcagcagcgccaagaactacttccactacaaccagagctacccccccacctacaacgtgaaggacatgctggtgcccaccgccgtgtggagcggcggccacgactggctggccgacgtgtacgacgtgaacatcctgctgacccagatcaccaacctggtgttccacgagagcatccccgagtgggagcacctggacttcatctggggcctggacgccccctggcgcctgtacaacaagatcatcaacctgatgcgcaagtaccag

SEQ ID NO: 1499 - DNA, 1203 bp, Artificial Sequence
  Description of Artificial Sequence: Synthetic coding sequence
atggcctgcctggagttcgtgcccttcgacgtgcagatgtgcctggagttcctgcccagcggcgagttcgtggtgctgctgaccagcggcgtgcagctgcagaccttcaccgtgagcgtgaccgacctgaagggcggcgccagcggcgtggtgcgcagcagccgctgggtgcgcggcttcaccgacttccgcagcaaggccgtggacctgtgcggccccaagcccgtggtgttcctgcagcacggcctgctggccgacagcagcaactgggtgaccaacctggccaacagcagcctgggcttcatcctggccgacgccggcttcgacgtgtggatgggcaacagccgcggcaacacctggagccgcaagcacaagaccctgagcgtgagccaggacgagttctgggccttccgcgtgcccttcctggactacagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagcgcatcaagatgttcttcgccctgggccccgtggccagcgtggccttctgcaccagccccatggccaagctgggccgcctgcccgaccacctgatcaaggacctgttcggcgacaaggagttcctgccccagagcgccttcctgaagtggctgggcacccacgtgtgcacccacgtgatcctgaaggagctgtgcggcaacctgtgcttcctgctgtgcggcttcaacgagcgcaacctgaacatgagccgcgtggacgtgtacaccacccacagccccgccggcaccagcgtgcagaacatgctgcactggagccaggccgtgaagttccagaagttccaggccttcgactggggcagcagcgccaagaactacttccactacaaccagagctacccccccacctacaacgtgaaggacatgctggtgcccaccgccgtgtggagcggcggccacgactggctggccgacgtgtacgacgtgaacatcctgctgacccagatcaccaacctggtgttccacgagagcatccccgagtgggagcacctggacttcatctggggcctggacgccccctggcgcctgtacaacaagatcatcaacctgatgcgcaagtaccag

SEQ ID NO: 1500 - DNA, 870 bp, Artificial Sequence
  Description of Artificial Sequence: Synthetic coding sequence
atgaagatgcgcttcctgggcctggtggtgtgcctggtgctgtggaccctgcacagcgagggcagcggcggcaagctgaccgccgtggaccccgagaccaacatgaacgtgagcgagatcatcagctactggggcttccccagcgaggagtacctggtggagaccgaggacggctacatcctgtgcctgaaccgcatcccccacggccgcaagaaccacagcgacaagggccccaagcccgtggtgttcctgcagcacggcctgctggccgacagcagcaactgggtgaccaacctggccaacagcagcctgggcttcatcctggccgacgccggcttcgacgtgtggatgggcaacagccgcggcaacacctggagccgcaagcacaagaccctgagcgtgagccaggacgagttctgggccttcagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagcgcatcaagatgttcttcgccctgggccccgtggccagcgtggccttctgcaccagccccatggccaagctgggccgcctgcccgaccacctgatcaaggacctgttcggcgacaaggagttcctgccccagagcgccttcctgaagtggctgggcacccacgtgtgcacccacgtgatcctgaaggagctgtgcggcaacctgtgcttcctgctgtgcggcttcaacgagcgcaacctgaacatgagccgcgtggacgtgtacaccacccacagccccgccggcaccagcgtg

SEQ ID NO: 1501 - DNA, 408 bp, Artificial Sequence
  Description of Artificial Sequence: Synthetic coding sequence
atgaagatgcgcttcctgggcctggtggtgtgcctggtgctgtggaccctgcacagcgagggcagcggcggcaagctgaccgccgtggaccccgagaccaacatgaacgtgagcgagatcatcagctactggggcttccccagcgaggagtacctggtggagaccgaggacggctacatcctgtgcctgaaccgcatcccccacggccgcaagaaccacagcgacaagggccccaagcccgtggtgttcctgcagcacggcctgctggccgacagcagcaactgggtgaccaacctggccaacagcagcctgggcttcatcctggccgacgccggcttcgacgtgtggatgggcaacagccgcggcaacacctggagccgcaagcacgtgaccctggagcccggctgc

SEQ ID NO: 1502 - DNA, 1425 bp, Artificial Sequence
  Description of Artificial Sequence: Synthetic coding sequence
atggagagcaaggccctgctggtgctgaccctggccgtgtggctgcagagcctgaccgccagccgcggcggcgtggccgccgccgaccagcgccgcgacttcatcgacatcgagagcaagttcgccctgcgcacccccgaggacaccgccgaggacacctgccacctgatccccggcgtggccgagagcgtggccacctgccacttcaaccacagcagcaagaccttcatggtgatccacggctggaccgtgaccggcatgtacgagagctgggtgcccaagctggtggccgccctgtacaagcgcgagcccgacagcaacgtgatcgtggtggactggctgagccgcgcccaggagcactaccccgtgagcgccggctacaccaagctggtgggccaggacgtggcccgcttcatcaactggatggaggaggagttcaactaccccctggacaacgtgcacctgctgggctacagcctgggcgcccacgccgccggcatcgccggcagcctgaccaacaagaaggtgaaccgcatcaccggcctggaccccgccggccccaacttcgagtacgccgaggcccccagccgcctgagccccgacgacgccgacttcgtggacgtgctgcacaccttcacccgcggcagccccggccgcagcatcggcatccagaagcccgtgggccacgtggacatctaccccaacggcggcaccttccagcccggctgcaacatcggcgaggccatccgcgtgatcgccgagcgcggcctgggcgacgtggaccagctggtgaagtgcagccacgagcgcagcatccacctgttcatcgacagcctgctgaacgaggagaaccccagcaaggcctaccgctgcagcagcaaggaggccttcgagaagggcctgtgcctgagctgccgcaagaaccgctgcaacaacctgggctacgagatcaacaaggtgcgcgccaagcgcagcagcaagatgtacctgaagacccgcagccagatgccctacaaggtgttccactaccaggtgaagatccacttcagcggcaccgagagcgagacccacaccaaccaggccttcgagatcagcctgtacggcaccgtggccgagagcgagaacatccccttcaccctgcccgaggtgagcaccaacaagacctacagcttcctgatctacaccgaggtggacatcggcgagctgctgatgctgaagctgaagtggaagagcgacagctacttcagctggagcgactggtggagcagccccggcttcgccatccagaagatccgcgtgaaggccggcgagacccagaagaaggtgatcttctgcagccgcgagaaggtgagccacctgcagaagggcaaggcccccgccgtgttcgtgaagtgccacgacaagagcctgaacaagaagagcggc

SEQ ID NO: 1503 - DNA, 345 bp, Artificial Sequence
  Description of Artificial Sequence: Synthetic coding sequence
atggtgatccacggctggaccgtgaccggcatgtacgagagctgggtgcccaagctggtggccgccctgtacaagcgcgagcccgacagcaacgtgatcgtggtggactggctgagccgcgcccaggagcactaccccgtgagcgccggctacaccaagctggtgggccaggacgtggcccgcttcatcaactggatggaggaggagttcaactaccccctggacaacgtgcacctgctgggctacagcctgggcgcccacgccgccggcatcgccggcagcctgaccaacaagaaggtgaaccgcatcaccggcctggaccccgccggccccaacttcgagtac

SEQ ID NO: 1504 - DNA, 318 bp, Artificial Sequence
  Description of Artificial Sequence: Synthetic coding sequence
atggagagcaaggccctgctggtgctgaccctggccgtgtggctgcagagcctgaccgccagccgcggcggcgtggccgccgccgaccagcgccgcgacttcatcgacatcgagagcaagttcgccctgcgcacccccgaggacaccgccgaggacacctgccacctgatccccggcgtggccgagagcgtggccacctgccacttcaaccacagcagcaagaccttcatggtgatccacggctggaccgtgaccggcatgtacgagagctgggtgcccaagctggtggccgccctgtacaagcgcgagcccgacagc

SEQ ID NO: 1505 - DNA, 390 bp, Artificial Sequence
  Description of Artificial Sequence: Synthetic coding sequence
atggagagcaaggccctgctggtgctgaccctggccgtgtggctgcagagcctgaccgccagccgcggcggcgtggccgccgccgaccagcgccgcgacttcatcgacatcgagagcaagttcgccctgcgcacccccgaggacaccgccgaggacacctgccacctgatccccggcgtggccgagagcgtggccacctgccacttcaaccacagcagcaagaccttcatggtgatccacggctggaccgtgaccggcatgtacgagagctgggtgcccaagctggtggccgccctgtacaagcgcgagcccgacagcaacgtgatcgtggtggactggctgagccgcgcccaggagcactaccccgtgagcgccggctacaccaagctg

SEQ ID NO: 1506 - DNA, 183 bp, Artificial Sequence
  Description of Artificial Sequence: Synthetic coding sequence
atgcagaaggagctgagccccgccacctgcccccacatcctgcgcgcccgcctgcccaagagcctgagcctgggctggagccgcgacggcggcgacaaccgcctgcccagcgccggcctggccttctggccctgccccagcagcctgccctgcacctgcaccagctggagcctgaacaaggcc

SEQ ID NO: 1507 - DNA, 228 bp, Artificial Sequence
  Description of Artificial Sequence: Synthetic coding sequence
atgaagtgggtgagcttcatcagcctgctgttcctgttcagcagcgcctacagcggcagcctggacaagcgccacggcgagggcaccttcaccagcgacgtgagcagctacctggagggccaggccgccaaggagttcatcgcctggctggtgaagggccgcggcagcccccagatgagccccgccaccctgaaggtgcgccagctgcgcagcctgagccccggcctg

SEQ ID NO: 1508 - DNA, 1740 bp, Artificial Sequence
  Description of Artificial Sequence: Synthetic coding sequence
atgaagtgggtgagcttcatcagcctgctgttcctgttcagcagcgcctacagcggcagcctggacaagcgccacggcgagggcaccttcaccagcgacgtgagcagctacctggaggagcaggccgccaaggagttcatcgcctggctggtgaagggccgcggccacggcgagggcaccttcaccagcgacgtgagcagctacctggaggagcaggccgccaaggagttcatcgcctggctggtgaagggccgcggccacggcgagggcaccttcaccagcgacgtgagcagctacctggaggagcaggccgccaaggagttcatcgcctggctggtgaagggccgcggccacggcgagggcaccttcaccagcgacgtgagcagctacctggaggagcaggccgccaaggagttcatcgcctggctggtgaagggccgcggccacggcgagggcaccttcaccagcgacgtgagcagctacctggaggagcaggccgccaaggagttcatcgcctggctggtgaagggccgcggccacggcgagggcaccttcaccagcgacgtgagcagctacctggaggagcaggccgccaaggagttcatcgcctggctggtgaagggccgcggccacggcgagggcaccttcaccagcgacgtgagcagctacctggaggagcaggccgccaaggagttcatcgcctggctggtgaagggccgcggccacggcgagggcaccttcaccagcgacgtgagcagctacctggaggagcaggccgccaaggagttcatcgcctggctggtgaagggccgcggccacggcgagggcaccttcaccagcgacgtgagcagctacctggaggagcaggccgccaaggagttcatcgcctggctggtgaagggccgcggccacggcgagggcaccttcaccagcgacgtgagcagctacctggaggagcaggccgccaaggagttcatcgcctggctggtgaagggccgcggcggcggcggcggcggcggcagcggcggcggcggcagcggcggcggcggcagcgccgagagcaagtacggccccccctgccccccctgccccgcccccgaggccgccggcggccccagcgtgttcctgttcccccccaagcccaaggacaccctgatgatcagccgcacccccgaggtgacctgcgtggtggtggacgtgagccaggaggaccccgaggtgcagttcaactggtacgtggacggcgtggaggtgcacaacgccaagaccaagccccgcgaggagcagttcaacagcacctaccgcgtggtgagcgtgctgaccgtgctgcaccaggactggctgaacggcaaggagtacaagtgcaaggtgagcaacaagggcctgcccagcagcatcgagaagaccatcagcaaggccaagggccagccccgcgagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccgcctgaccgtggacaagagccgctggcaggagggcaacgtgttcagctgcagcgtgatgcacgaggccctgcacaaccactacacccagaagagcctgagcctgagcctgggc

SEQ ID NO: 1509 - DNA, 165 bp, Artificial Sequence
  Description of Artificial Sequence: Synthetic coding sequence
atgcccagcagcgtgagctggggcatcctgctgctggccggcctgtgctgcctggtgcccgtgagcctggcccacgccgagggcaccttcaccagcgacgtgagcagctacctggagggccaggccgccaaggagttcatcgcctggctggtgcgcggccgcggc

SEQ ID NO: 1510 - DNA, 2076 bp, Artificial Sequence
  Description of Artificial Sequence: Synthetic coding sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggccgcgtgaaccgctgcatcccccagttctggcgctgcgacggccaggtggactgcgacaacggcagcgacgagcagggctgcctgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcggcgtgaactggtgcgagcgcaccaccctgagcaacggcggctgccagtacctgtgcctgcccgccccccagatcaacccccacagccccaagttcacctgcgcctgccccgacggcatgctgctggcccgcgacatgcgcagctgcctgaccgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagccgccagatggtgagcctggaggacgacgtggcc

SEQ ID NO: 1511 - DNA, 2457 bp, Artificial Sequence
  Description of Artificial Sequence: Synthetic coding sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcagccccaagacctgcagccaggacgagttccgctgccacgacggcaagtgcatcagccgccagttcgtgtgcgacagcgaccgcgactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagcgctgccgcggcctgtacgtgttccagggcgacagcagcccctgcagcgccttcgagttccactgcctgagcggcgagtgcatccacagcagctggcgctgcgacggcggccccgactgcaaggacaagagcgacgaggagaactgcgccgtggccacctgccgccccgacgagttccagtgcagcgacggcaactgcatccacggcagccgccagtgcgaccgcgagtacgactgcaaggacatgagcgacgaggtgggctgcgtgaacgtgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcggcgtgaactggtgcgagcgcaccaccctgagcaacggcggctgccagtacctgtgcctgcccgccccccagatcaacccccacagccccaagttcacctgcgcctgccccgacggcatgctgctggcccgcgacatgcgcagctgcctgaccgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagccgccagatggtgagcctggaggacgacgtggcc

SEQ ID NO: 1512 - DNA, 2046 bp, Artificial Sequence
  Description of Artificial Sequence: Synthetic coding sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggccgcgtgaaccgctgcatcccccagttctggcgctgcgacggccaggtggactgcgacaacggcagcgacgagcagggctgccccgtggccacctgccgccccgacgagttccagtgcagcgacggcaactgcatccacggcagccgccagtgcgaccgcgagtacgactgcaaggacatgagcgacgaggtgggctgcgtgaacgtgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagccgccagatggtgagcctggaggacgacgtggcc

SEQ ID NO: 1513 - DNA, 2574 bp, Artificial Sequence
  Description of Artificial Sequence: Synthetic coding sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggccgcgtgaaccgctgcatcccccagttctggcgctgcgacggccaggtggactgcgacaacggcagcgacgagcagggctgcccccccaagacctgcagccaggacgagttccgctgccacgacggcaagtgcatcagccgccagttcgtgtgcgacagcgaccgcgactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagcgctgccgcggcctgtacgtgttccagggcgacagcagcccctgcagcgccttcgagttccactgcctgagcggcgagtgcatccacagcagctggcgctgcgacggcggccccgactgcaaggacaagagcgacgaggagaactgcgccgtggccacctgccgccccgacgagttccagtgcagcgacggcaactgcatccacggcagccgccagtgcgaccgcgagtacgactgcaaggacatgagcgacgaggtgggctgcgtgaacgtgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcggcgtgaactggtgcgagcgcaccaccctgagcaacggcggctgccagtacctgtgcctgcccgccccccagatcaacccccacagccccaagttcacctgcgcctgccccgacggcatgctgctggcccgcgacatgcgcagctgcctgaccgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagcatggtgagcctggaggacgacgtggcc

SEQ ID NO: 1514 - DNA, 2580 bp, Artificial Sequence
  Description of Artificial Sequence: Synthetic coding sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggccgcgtgaaccgctgcatcccccagttctggcgctgcgacggccaggtggactgcgacaacggcagcgacgagcagggctgcccccccaagacctgcagccaggacgagttccgctgccacgacggcaagtgcatcagccgccagttcgtgtgcgacagcgaccgcgactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagcgctgccgcggcctgtacgtgttccagggcgacagcagcccctgcagcgccttcgagttccactgcctgagcggcgagtgcatccacagcagctggcgctgcgacggcggccccgactgcaaggacaagagcgacgaggagaactgcgccgtggccacctgccgccccgacgagttccagtgcagcgacggcaactgcatccacggcagccgccagtgcgaccgcgagtacgactgcaaggacatgagcgacgaggtgggctgcgtgaacgtgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcggcgtgaactggtgcgagcgcaccaccctgagcaacggcggctgccagtacctgtgcctgcccgccccccagatcaacccccacagccccaagttcacctgcgcctgccccgacggcatgctgctggcccgcgacatgcgcagctgcctgaccgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagccgccagatggtgagcctggaggacgacgtggcc

SEQ ID NO: 1515 - DNA, 558 bp, Artificial Sequence
  Description of Artificial Sequence: Synthetic coding sequence
cgcggcggcggcgacagctacggcgtgctgctgagcaacgccctggcccgcctgcgcggcttcaaggaccacttcaccttctgccagcagctgaacatcagcatctgccccctgagccagaccgccgcccgcttccaggtgatcgtgtacaaccccctgggccgcaaggtgaactggatggtgcgcctgcccgtgagcgagggcgtgttcgtggtgaaggaccccaacggccgcaccgtgcccagcgacgtggtgatcttccccagcagcgacagccaggcccacccccccgagctgctgttcagcgccagcctgcccgccctgggcttcagcacctacagcgtggcccaggtgccccgctggaagccccaggcccgcgccccccagcccatcccccgccgcagctggagccccgccctgaccatcgagaacgagcacatccgcgccaccttcgaccccgacaccggcctgctgatggagatcatgaacatgaaccagcagctgctgctgcccgtgcgccagaccttcttctggtacaacgccagcatcggcgacaac

SEQ ID NO: 1516 - DNA, 3033 bp, Artificial Sequence
  Description of Artificial Sequence: Synthetic coding sequence
atgggcgcctacgcccgcgccagcggcgtgtgcgcccgcggctgcctggacagcgccggcccctggaccatgagccgcgccctgcgcccccccctgccccccctgtgcttcttcctgctgctgctggccgccgccggcgcccgcgccggcggctacgagacctgccccaccgtgcagcccaacatgctgaacgtgcacctgctgccccacacccacgacgacgtgggctggctgaagaccgtggaccagtacttctacggcatcaagaacgacatccagcacgccggcgtgcagtacatcctggacagcgtgatcagcgccctgctggccgaccccacccgccgcttcatctacgtggagatcgccttcttcagccgctggtggcaccagcagaccaacgccacccaggaggtggtgcgcgacctggtgcgccagggccgcctggagttcgccaacggcggctgggtgatgaacgacgaggccgccacccactacggcgccatcgtggaccagatgaccctgggcctgcgcttcctggaggacaccttcggcaacgacggccgcccccgcgtggcctggcacatcgaccccttcggccacagccgcgagcaggccagcctgttcgcccagatgggcttcgacggcttcttcttcggccgcctggactaccaggacaagtgggtgcgcatgcagaagctggagatggagcaggtgtggcgcgccagcaccagcctgaagccccccaccgccgacctgttcaccggcgtgctgcccaacggctacaaccccccccgcaacctgtgctgggacgtgctgtgcgtggaccagcccctggtggaggacccccgcagccccgagtacaacgccaaggagctggtggactacttcctgaacgtggccaccgcccagggccgctactaccgcaccaaccacaccgtgatgaccatgggcagcgacttccagtacgagaacgccaacatgtggttcaagaacctggacaagctgatccgcctggtgaacgcccagcaggccaagggcagcagcgtgcacgtgctgtacagcacccccgcctgctacctgtgggagctgaacaaggccaacctgacctggagcgtgaagcacgacgacttcttcccctacgccgacggcccccaccagttctggaccggctacttcagcagccgccccgccctgaagcgctacgagcgcctgagctacaacttcctgcaggtgtgcaaccagctggaggccctggtgggcctggccgccaacgtgggcccctacggcagcggcgacagcgcccccctgaacgaggccatggccgtgctgcagcaccacgacgccgtgagcggcaccagccgccagcacgtggccaacgactacgcccgccagctggccgccggctggggcccctgcgaggtgctgctgagcaacgccctggcccgcctgcgcggcttcaaggaccacttcaccttctgccagcagctgaacatcagcatctgccccctgagccagaccgccgcccgcttccaggtgatcgtgtacaaccccctgggccgcaaggtgaactggatggtgcgcctgcccgtgagcgagggcgtgttcgtggtgaaggaccccaacggccgcaccgtgcccagcgacgtggtgatcttccccagcagcgacagccaggcccacccccccgagctgctgttcagcgccagcctgcccgccctgggcttcagcacctacagcgtggcccaggtgccccgctggaagccccaggcccgcgccccccagcccatcccccgccgcagctggagccccgccctgaccatcgagaacgagcacatccgcgccaccttcgaccccgacaccggcctgctgatggagatcatgaacatgaaccagcagctgctgctgcccgtgcgccagaccttcttctggtacaacgccagcatcggcgacaacgagagcgaccaggccagcggcgcctacatcttccgccccaaccagcagaagcccctgcccgtgagccgctgggcccagatccacctggtgaagacccccctggtgcaggaggtgcaccagaacttcagcgcctggtgcagccaggtggtgcgcctgtaccccggccagcgccacctggagctggagtggagcgtgggccccatccccgtgggcgacacctggggcaaggaggtgatcagccgcttcgacacccccctggagaccaagggccgcttctacaccgacagcaacggccgcgagatcctggagcgccgccgcgactaccgccccacctggaagctgaaccagaccgagcccgtggccggcaactactaccccgtgaacacccgcatctacatcaccgacggcaacatgcagctgaccgtgctgaccgaccgcagccagggcggcagcagcctgcgcgacggcagcctggagctgatggtgcaccgccgcctgctgaaggacgacggccgcggcgtgagcgagcccctgatggagaacggcagcggcgcctgggtgcgcggccgccacctggtgctgctggacaccgcccaggccgccgccgccggccaccgcctgctggccgagcaggaggtgctggccccccaggtggtgctggcccccggcggcggcgccgcctacaacctgggcgcccccccccgcacccagttcagcggcctgcgccgcgacctgccccccagcgtgcacctgctgaccctggccagctggggccccgagatggtgctgctgcgcctggagcaccagttcgccgtgggcgaggacagcggccgcaacctgagcgcccccgtgaccctgaacctgcgcgacctgttcagcaccttcaccatcacccgcctgcaggagaccaccctggtggccaaccagctgcgcgaggccgccagccgcctgaagtggaccaccaacaccggccccaccccccaccagaccccctaccagctggaccccgccaacatcaccctggagcccatggagatccgcaccttcctggccagcgtgcagtggaaggaggtggacggc

SEQ ID NO: 1517 - DNA, 2250 bp, Artificial Sequence
  Description of Artificial Sequence: Synthetic coding sequence
atgctgcgcgccaagaaccagctgttcctgctgagcccccactacctgcgccaggtgaaggagagcagcggcagccgcctgatccagcagcgcctgctgcaccagcagcagcccctgcaccccgagtgggccgccctggccaagaagcagctgaagggcaagaaccccgaggacctgatctggcacacccccgagggcatcagcatcaagcccctgtacagcaagcgcgacaccatggacctgcccgaggagctgcccggcgtgaagcccttcacccgcggcccctaccccaccatgtacaccttccgcccctggaccatccgccagtacgccggcttcagcaccgtggaggagagcaacaagttctacaaggacaacatcaaggccggccagcagggcctgagcgtggccttcgacctggccacccaccgcggctacgacagcgacaacccccgcgtgcgcggcgacgtgggcatggccggcgtggccatcgacaccgtggaggacaccaagatcctgttcgacggcatccccctggagaagatgagcgtgagcatgaccatgaacggcgccgtgatccccgtgctggccaacttcatcgtgaccggcgaggagcagggcgtgcccaaggagaagctgaccggcaccatccagaacgacatcctgaaggagttcatggtgcgcaacacctacatcttcccccccgagcccagcatgaagatcatcgccgacatcttcgagtacaccgccaagcacatgcccaagttcaacagcatcagcatcagcggctaccacatgcaggaggccggcgccgacgccatcctggagctggcctacaccctggccgacggcctggagtacagccgcaccggcctgcaggccggcctgaccatcgacgagttcgccccccgcctgagcttcttctggggcatcggcatgaacttctacatggagatcgccaagatgcgcgccggccgccgcctgtgggcccacctgatcgagaagatgttccagcccaagaacagcaagagcctgctgctgcgcgcccactgccagaccagcggctggagcctgaccgagcaggacccctacaacaacatcgtgcgcaccgccatcgaggccatggccgccgtgttcggcggcacccagagcctgcacaccaacagcttcgacgaggccctgggcctgcccaccgtgaagagcgcccgcatcgcccgcaacacccagatcatcatccaggaggagagcggcatccccaaggtggccgacccctggggcggcagctacatgatggagtgcctgaccaacgacgtgtacgacgccgccctgaagctgatcaacgagatcgaggagatgggcggcatggccaaggccgtggccgagggcatccccaagctgcgcatcgaggagtgcgccgcccgccgccaggcccgcatcgacagcggcagcgaggtgatcgtgggcgtgaacaagtaccagctggagaaggaggacgccgtggaggtgctggccatcgacaacaccagcgtgcgcaaccgccagatcgagaagctgaagaagatcaagagcagccgcgaccaggccctggccgagcgctgcctggccgccctgaccgagtgcgccgccagcggcgacggcaacatcctggccctggccgtggacgccagccgcgcccgctgcaccgtgggcgagatcaccgacgccctgaagaaggtgttcggcgagcacaaggccaacgaccgcatggtgagcggcgcctaccgccaggagttcggcgagagcaaggagatcaccagcgccatcaagcgcgtgcacaagttcatggagcgcgagggccgccgcccccgcctgctggtggccaagatgggccaggacggccacgaccgcggcgccaaggtgatcgccaccggcttcgccgacctgggcttcgacgtggacatcggccccctgttccagaccccccgcgaggtggcccagcaggccgtggacgccgacgtgcacgccgtgggcatcagcaccctggccgccggccacaagaccctggtgcccgagctgatcaaggagctgaacagcctgggccgccccgacatcctggtgatgtgcggcggcgtgatccccccccaggactacgagttcctgttcgaggtgggcgtgagcaacgtgttcggccccggcacccgcatccccaaggccgccgtgcaggtgctggacgacatcgagaagtgcctggagaagaagcagcagagcgtg

SEQ ID NO: 1518 - DNA, 2682 bp, Artificial Sequence
  Description of Artificial Sequence: Synthetic coding sequence
atgatcctgctggccgtgctgttcctgtgcttcatcagcagctacagcgccagcgtgaagggccacaccaccggcctgagcctgaacaacgaccgcctgtacaagctgacctacagcaccgaggtgctgctggaccgcggcaagggcaagctgcaggacagcgtgggctaccgcatcagcagcaacgtggacgtggccctgctgtggcgcaaccccgacggcgacgacgaccagctgatccagatcaccatgaaggacgtgaacgtggagaacgtgaaccagcagcgcggcgagaagagcatcttcaagggcaagagccccagcaagatcatgggcaaggagaacctggaggccctgcagcgccccaccctgctgcacctgatccacggcaaggtgaaggagttctacagctaccagaacgaggccgtggccatcgagaacatcaagcgcggcctggccagcctgttccagacccagctgagcagcggcaccaccaacgaggtggacatcagcggcaactgcaaggtgacctaccaggcccaccaggacaaggtgatcaagatcaaggccctggacagctgcaagatcgcccgcagcggcttcaccacccccaaccaggtgctgggcgtgagcagcaaggccaccagcgtgaccacctacaagatcgaggacagcttcgtgatcgccgtgctggccgaggagacccacaacttcggcctgaacttcctgcagaccatcaagggcaagatcgtgagcaagcagaagctggagctgaagaccaccgaggccggcccccgcctgatgagcggcaagcaggccgccgccatcatcaaggccgtggacagcaagtacaccgccatccccatcgtgggccaggtgttccagagccactgcaagggctgccccagcctgagcgagctgtggcgcagcacccgcaagtacctgcagcccgacaacctgagcaaggccgaggccgtgcgcaacttcctggccttcatccagcacctgcgcaccgccaagaaggaggagatcctgcagatcctgaagatggagaacaaggaggtgctgccccagctggtggacgccgtgaccagcgcccagaccagcgacagcctggaggccatcctggacttcctggacttcaagagcgacagcagcatcatcctgcaggagcgcttcctgtacgcctgcggcttcgccagccaccccaacgaggagctgctgcgcgccctgatcagcaagttcaagggcagcatcggcagcagcgacatccgcgagaccgtgatgatcatcaccggcaccctggtgcgcaagctgtgccagaacgagggctgcaagctgaaggccgtggtggaggccaagaagctgatcctgggcggcctggagaaggccgagaagaaggaggacacccgcatgtacctgctggccctgaagaacgccctgctgcccgagggcatccccagcctgctgaagtacgccgaggccggcgagggccccatcagccacctggccaccaccgccctgcagcgctacgacctgcccttcatcaccgacgaggtgaagaagaccctgaaccgcatctaccaccagaaccgcaaggtgcacgagaagaccgtgcgcaccgccgccgccgccatcatcctgaacaacaaccccagctacatggacgtgaagaacatcctgctgagcatcggcgagctgccccaggagatgaacaagtacatgctggccatcgtgcaggacatcctgcgcttcgagatgcccgccagcaagatcgtgcgccgcgtgctgaaggagatggtggcccacaactacgaccgcttcagccgcagcggcagcagcagcgcctacaccggctacatcgagcgcagcccccgcagcgccagcacctacagcctggacatcctgtacagcggcagcggcatcctgcgccgcagcaacctgaacatcttccagtacatcggcaaggccggcctgcacggcagccaggtggtgatcgaggcccagggcctggaggccctgatcgccgccacccccgacgagggcgaggagaacctggacagctacgccggcatgagcgccatcctgttcgacgtgcagctgcgccccgtgaccttcttcaacggctacagcgacctgatgagcaagatgctgagcgccagcggcgaccccatcagcgtggtgaagggcctgatcctgctgatcgaccacagccaggagctgcagctgcagagcggcctgaaggccaacatcgaggtgcagggcggcctggccatcgacatcagcggcgccatggagttcagcctgtggtaccgcgagagcaagacccgcgtgaagaaccgcgtgaccgtggtgatcaccaccgacatcaccgtggacagcagcttcgtgaaggccggcctggagaccagcaccgagaccgaggccggcctggagttcatcagcaccgtgcagttcagccagtaccccttcctggtgtgcatgcagatggacaaggacgaggcccccttccgccagttcgagaagaagtacgagcgcctgagcaccggccgcggctacgtgagccagaagcgcaaggagagcgtgctggccggctgcgagttccccctgcaccaggagaacagcgagatgtgcaaggtggtgttcgccccccagcccgacagcaccagcagcggctggttc

SEQ ID NO: 1519 - DNA, 534 bp, Artificial Sequence
  Description of Artificial Sequence: Synthetic coding sequence
atggcccgcgcccccctgcgccccgagaacaccatcgtgcgcggcagcgccaaccagtgccaggacacctaccgcgccgaggagctgaccggccacaccaccggcctgagcctgaacaacgaccgcctgtacaagctgacctacagcaccgaggtgctgctggaccgcggcaagggcaagctgcaggacagcgtgggctaccgcatcagcagcaacgtggacgtggccctgctgtggcgcaaccccgacggcgacgacgaccagctgatccagatcaccatgaaggacgtgaacgtggagaacgtgaaccagcagcgcggcgagaagagcatcttcaagggcaagagccccagcaagatcatgggcaaggagaacctggaggccctgcagcgccccaccctgctgcacctgatccacggcaaggtgaaggagttctacagctaccagaacgaggccgtggccatcgagaacatcaagcgcggcctggccagcctgttccagacccagctgagcagcggcaccaccaacgaggtg

SEQ ID NO: 1520 - DNA, 3768 bp, Artificial Sequence
  Description of Artificial Sequence: Synthetic coding sequence
atgctgttcaagctgctgcagcgccagacctacacctgcctgagccaccgctacggcctgtacgtgtgcttcctgggcgtggtggtgaccatcgtgagcgccttccagttcggcgaggtggtgctggagtggagccgcgaccagtaccacgtgctgttcgacagctaccgcgacaacatcgccggcaagagcttccagaaccgcctgtgcctgcccatgcccatcgacgtggtgtacacctgggtgaacggcaccgacctggagctgctgaaggagctgcagcaggtgcgcgagcagatggaggaggagcagaaggccatgcgcgagatcctgggcaagaacaccaccgagcccaccaagaagagcgagaagcagctggagtgcctgctgacccactgcatcaaggtgcccatgctggtgctggaccccgccctgcccgccaacatcaccctgaaggacctgcccagcctgtaccccagcttccacagcgccagcgacatcttcaacgtggccaagcccaagaaccccagcaccaacgtgagcgtggtggtgttcgacagcaccaaggacgtggaggacgcccacagcggcctgctgaagggcaacagccgccagaccgtgtggcgcggctacctgaccaccgacaaggaggtgcccggcctggtgctgatgcaggacctggccttcctgagcggcttcccccccaccttcaaggagaccaaccagctgaagaccaagctgcccgagaacctgagcagcaaggtgaagctgctgcagctgtacagcgaggccagcgtggccctgctgaagctgaacaaccccaaggacttccaggagctgaacaagcagaccaagaagaacatgaccatcgacggcaaggagctgaccatcagccccgcctacctgctgtgggacctgagcgccatcagccagagcaagcaggacgaggacatcagcgccagccgcttcgaggacaacgaggagctgcgctacagcctgcgcagcatcgagcgccacgccccctgggtgcgcaacatcttcatcgtgaccaacggccagatccccagctggctgaacctggacaacccccgcgtgaccatcgtgacccaccaggacgtgttccgcaacctgagccacctgcccaccttcagcagccccgccatcgagagccacatccaccgcatcgagggcctgagccagaagttcatctacctgaacgacgacgtgatgttcggcaaggacgtgtggcccgacgacttctacagccacagcaagggccagaaggtgtacctgacctggcccgtgcccaactgcgccgagggctgccccggcagctggatcaaggacggctactgcgacaaggcctgcaacaacagcgcctgcgactgggacggcggcgactgcagcggcaacagcggcggcagccgctacatcgccggcggcggcggcaccggcagcatcggcgtgggccagccctggcagttcggcggcggcatcaacagcgtgagctactgcaaccagggctgcgccaacagctggctggccgacaagttctgcgaccaggcctgcaacgtgctgagctgcggcttcgacgccggcgactgcggccaggaccacttccacgagctgtacaaggtgatcctgctgcccaaccagacccactacatcatccccaagggcgagtgcctgccctacttcagcttcgccgaggtggccaagcgcggcgtggagggcgcctacagcgacaaccccatcatccgccacgccagcatcgccaacaagtggaagaccatccacctgatcatgcacagcggcatgaacgccaccaccatccacttcaacctgaccttccagaacaccaacgacgaggagttcaagatgcagatcaccgtggaggtggacacccgcgagggccccaagctgaacagcaccgcccagaagggctacgagaacctggtgagccccatcaccctgctgcccgaggccgagatcctgttcgaggacatccccaaggagaagcgcttccccaagttcaagcgccacgacgtgaacagcacccgccgcgcccaggaggaggtgaagatccccctggtgaacatcagcctgctgcccaaggacgcccagctgagcctgaacaccctggacctgcagctggagcacggcgacatcaccctgaagggctacaacctgagcaagagcgccctgctgcgcagcttcctgatgaacagccagcacgccaagatcaagaaccaggccatcatcaccgacgagaccaacgacagcctggtggccccccaggagaagcaggtgcacaagagcatcctgcccaacagcctgggcgtgagcgagcgcctgcagcgcctgaccttccccgccgtgagcgtgaaggtgaacggccacgaccagggccagaacccccccctggacctggagaccaccgcccgcttccgcgtggagacccacacccagaagaccatcggcggcaacgtgaccaaggagaagccccccagcctgatcgtgcccctggagagccagatgaccaaggagaagaagatcaccggcaaggagaaggagaacagccgcatggaggagaacgccgagaaccacatcggcgtgaccgaggtgctgctgggccgcaagctgcagcactacaccgacagctacctgggcttcctgccctgggagaagaagaagtacttccaggacctgctggacgaggaggagagcctgaagacccagctggcctacttcaccgacagcaagaacaccggccgccagctgaaggacaccttcgccgacagcctgcgctacgtgaacaagatcctgaacagcaagttcggcttcaccagccgcaaggtgcccgcccacatgccccacatgatcgaccgcatcgtgatgcaggagctgcaggacatgttccccgaggagttcgacaagaccagcttccacaaggtgcgccacagcgaggacatgcagttcgccttcagctacttctactacctgatgagcgccgtgcagcccctgaacatcagccaggtgttcgacgaggtggacaccgaccagagcggcgtgctgagcgaccgcgagatccgcaccctggccacccgcatccacgagctgcccctgagcctgcaggacctgaccggcctggagcacatgctgatcaactgcagcaagatgctgcccgccgacatcacccagctgaacaacatcccccccacccaggagagctactacgaccccaacctgccccccgtgaccaagagcctggtgaccaactgcaagcccgtgaccgacaagatccacaaggcctacaaggacaagaacaagtaccgcttcgagatcatgggcgaggaggagatcgccttcaagatgatccgcaccaacgtgagccacgtggtgggccagctggacgacatccgcaagaacccccgcaagttcgtgtgcctgaacgacaacatcgaccacaaccacaaggacgcccagaccgtgaaggccgtgctgcgcgacttctacgagagcatgttccccatccccagccagttcgagctgccccgcgagtaccgcaaccgcttcctgcacatgcacgagctgcaggagtggcgcgcctaccgcgacaagctgaagttctggacccactgcgtgctggccaccctgatcatgttcaccatcttcagcttcttcgccgagcagctgatcgccctgaagcgcaagatcttcccccgccgccgcatccacaaggaggccagccccaaccgcatccgcgtg

SEQ ID NO: 1521 - DNA, 1470 bp, Artificial Sequence
  Description of Artificial Sequence: Synthetic coding sequence
atgctgttcaagctgctgcagcgccagacctacacctgcctgagccaccgctacggcctgtacgtgtgcttcctgggcgtggtggtgaccatcgtgagcgccttccagttcggcgaggtggtgctggagtggagccgcgaccagtaccacgtgctgttcgacagctaccgcgacaacatcgccggcaagagcttccagaaccgcctgtgcctgcccatgcccatcgacgtggtgtacacctgggtgaacggcaccgacctggagctgctgaaggagctgcagcaggtgcgcgagcagatggaggaggagcagaaggccatgcgcgagatcctgggcaagaacaccaccgagcccaccaagaagagcgagaagcagctggagtgcctgctgacccactgcatcaaggtgcccatgctggtgctggaccccgccctgcccgccaacatcaccctgaaggacctgcccagcctgtaccccagcttccacagcgccagcgacatcttcaacgtggccaagcccaagaaccccagcaccaacgtgagcgtggtggtgttcgacagcaccaaggacgtggaggacgcccacagcggcctgctgaagggcaacagccgccagaccgtgtggcgcggctacctgaccaccgacaaggaggtgcccggcctggtgctgatgcaggacctggccttcctgagcggcttcccccccaccttcaaggagaccaaccagctgaagaccaagctgcccgagaacctgagcagcaaggtgaagctgctgcagctgtacagcgaggccagcgtggccctgctgaagctgaacaaccccaaggacttccaggagctgaacaagcagaccaagaagaacatgaccatcgacggcaaggagctgaccatcagccccgcctacctgctgtgggacctgagcgccatcagccagagcaagcaggacgaggacatcagcgccagccgcttcgaggacaacgaggagctgcgctacagcctgcgcagcatcgagcgccacgccccctgggtgcgcaacatcttcatcgtgaccaacggccagatccccagctggctgaacctggacaacccccgcgtgaccatcgtgacccaccaggacgtgttccgcaacctgagccacctgcccaccttcagcagccccgccatcgagagccacatccaccgcatcgagggcctgagccagaagttcatctacctgaacgacgacgtgatgttcggcaaggacgtgtggcccgacgacttctacagccacagcaagggccagaaggtgtacctgacctggcccgtgcccaactgcgccgagggctgccccggcagctggatcaaggacggctactgcgacaaggcctgcaacaacagcgcctgcgactgggacggcggcgactgcagcggcaaggacgtgctgaactgcaacagcttcatcttcatggagtacttcctgctgaaccactac

SEQ ID NO: 1522 - DNA, 1185 bp, Artificial Sequence
  Description of Artificial Sequence: Synthetic coding sequence
atgcccggccgcagctgcgtggccctggtgctgctggccgccgccgtgagctgcgccgtggcccagcacgcccccccctggaccgaggactgccgcaagagcacctacccccccagcggccccacctaccgcggcgccgtgccctggtacaccatcaacctggacctgcccccctacaagcgctggcacgagctgatgctggacaaggcccccgtgctgaaggtgatcgtgaacagcctgaagaacatgatcaacaccttcgtgcccagcggcaagatcatgcaggtggtggacgagaagctgcccggcctgctgggcaacttccccggccccttcgaggaggagatgaagggcatcgccgccgtgaccgacatccccctgggcgagatcatcagcttcaacatcttctacgagctgttcaccatctgcaccagcatcgtggccgaggacaagaagggccacctgatccacggccgcaacatggacttcggcgtgttcctgggctggaacatcaacaacgacacctgggtgatcaccgagcagctgaagcccctgaccgtgaacctggacttccagcgcaacaacaagaccgtgttcaaggccagcagcttcgccggctacgtgggcatgctgaccggcttcaagcccggcctgttcagcctgaccctgaacgagcgcttcagcatcaacggcggctacctgggcatcctggagtggatcctgggcaagaaggacgtgatgtggatcggcttcctgacccgcaccgtgctggagaacagcaccagctacgaggaggccaagaacctgctgaccaagaccaagatcctggcccccgcctacttcatcctgggcggcaaccagagcggcgagggctgcgtgatcacccgcgaccgcaaggagagcctggacgtgtacgagctggacgccaagcagggccgctggtacgtggtgcagaccaactacgaccgctggaagcaccccttcttcctggacgaccgccgcacccccgccaagatgtgcctgaaccgcaccagccaggagaacatcagcttcgagaccatgtacgacgtgctgagcaccaagcccgtgctgaacaagctgaccgtgtacaccaccctgatcgacgtgaccaagggccagttcgagacctacctgcgcgactgccccgacccctgcatcggctgg

SEQ ID NO: 1523 - DNA, 1167 bp, Artificial Sequence
  Description of Artificial Sequence: Synthetic coding sequence
atgaactgctgcatcggcctgggcgagaaggcccgcggcagccaccgcgccagctaccccagcctgagcgccctgttcaccgaggccagcatcctgggcttcggcagcttcgccgtgaaggcccagtggaccgaggactgccgcaagagcacctacccccccagcggccccaccgtgttccccgccgtgatccgctaccgcggcgccgtgccctggtacaccatcaacctggacctgcccccctacaagcgctggcacgagctgatgctggacaaggcccccgtgcccggcctgctgggcaacttccccggccccttcgaggaggagatgaagggcatcgccgccgtgaccgacatccccctgggcgagatcatcagcttcaacatcttctacgagctgttcaccatctgcaccagcatcgtggccgaggacaagaagggccacctgatccacggccgcaacatggacttcggcgtgttcctgggctggaacatcaacaacgacacctgggtgatcaccgagcagctgaagcccctgaccgtgaacctggacttccagcgcaacaacaagaccgtgttcaaggccagcagcttcgccggctacgtgggcatgctgaccggcttcaagcccggcctgttcagcctgaccctgaacgagcgcttcagcatcaacggcggctacctgggcatcctggagtggatcctgggcaagaaggacgtgatgtggatcggcttcctgacccgcaccgtgctggagaacagcaccagctacgaggaggccaagaacctgctgaccaagaccaagatcctggcccccgcctacttcatcctgggcggcaaccagagcggcgagggctgcgtgatcacccgcgaccgcaaggagagcctggacgtgtacgagctggacgccaagcagggccgctggtacgtggtgcagaccaactacgaccgctggaagcaccccttcttcctggacgaccgccgcacccccgccaagatgtgcctgaaccgcaccagccaggagaacatcagcttcgagaccatgtacgacgtgctgagcaccaagcccgtgctgaacaagctgaccgtgtacaccaccctgatcgacgtgaccaagggccagttcgagacctacctgcgcgactgccccgacccctgcatcggctgg

SEQ ID NO: 1524 - DNA, 1233 bp, Artificial Sequence
  Description of Artificial Sequence: Synthetic coding sequence
atgaactgctgcatcggcctgggcgagaaggcccgcggcagccaccgcgccagctaccccagcctgagcgccctgttcaccgaggccagcatcctgggcttcggcagcttcgccgtgaaggcccagtggaccgaggactgccgcaagagcacctacccccccagcggccccacctaccgcggcgccgtgccctggtacaccatcaacctggacctgcccccctacaagcgctggcacgagctgatgctggacaaggcccccgtgctgaaggtgatcgtgaacagcctgaagaacatgatcaacaccttcgtgcccagcggcaagatcatgcaggtggtggacgagaagctgcccggcctgctgggcaacttccccggccccttcgaggaggagatgaagggcatcgccgccgtgaccgacatccccctgggcgagatcatcagcttcaacatcttctacgagctgttcaccatctgcaccagcatcgtggccgaggacaagaagggccacctgatccacggccgcaacatggacttcggcgtgttcctgggctggaacatcaacaacgacacctgggtgatcaccgagcagctgaagcccctgaccgtgaacctggacttccagcgcaacaacaagaccgtgttcaaggccagcagcttcgccggctacgtgggcatgctgaccggcttcaagcccggcctgttcagcctgaccctgaacgagcgcttcagcatcaacggcggctacctgggcatcctggagtggatcctgggcaagaaggacgtgatgtggatcggcttcctgacccgcaccgtgctggagaacagcaccagctacgaggaggccaagaacctgctgaccaagaccaagatcctggcccccgcctacttcatcctgggcggcaaccagagcggcgagggctgcgtgatcacccgcgaccgcaaggagagcctggacgtgtacgagctggacgccaagcagggccgctggtacgtggtgcagaccaactacgaccgctggaagcaccccttcttcctggacgaccgccgcacccccgccaagatgtgcctgaaccgcaccagccaggagaacatcagcttcgagaccatgtacgacgtgctgagcaccaagcccgtgctgaacaagctgaccgtgtacaccaccctgatcgacgtgaccaagggccagttcgagacctacctgcgcgactgccccgacccctgcatcggctgg

SEQ ID NO: 1525 - DNA, 915 bp, Artificial Sequence
  Description of Artificial Sequence: Synthetic coding sequence
atgctggacaaggcccccgtgctgaaggtgatcgtgaacagcctgaagaacatgatcaacaccttcgtgcccagcggcaagatcatgcaggtggtggacgagaagctgcccggcctgctgggcaacttccccggccccttcgaggaggagatgaagggcatcgccgccgtgaccgacatccccctgggccacctgatccacggccgcaacatggacttcggcgtgttcctgggctggaacatcaacaacgacacctgggtgatcaccgagcagctgaagcccctgaccgtgaacctggacttccagcgcaacaacaagaccgtgttcaaggccagcagcttcgccggctacgtgggcatgctgaccggcttcaagcccggcctgttcagcctgaccctgaacgagcgcttcagcatcaacggcggctacctgggcatcctggagtggatcctgggcaagaaggacgtgatgtggatcggcttcctgacccgcaccgtgctggagaacagcaccagctacgaggaggccaagaacctgctgaccaagaccaagatcctggcccccgcctacttcatcctgggcggcaaccagagcggcgagggctgcgtgatcacccgcgaccgcaaggagagcctggacgtgtacgagctggacgccaagcagggccgctggtacgtggtgcagaccaactacgaccgctggaagcaccccttcttcctggacgaccgccgcacccccgccaagatgtgcctgaaccgcaccagccaggagaacatcagcttcgagaccatgtacgacgtgctgagcaccaagcccgtgctgaacaagctgaccgtgtacaccaccctgatcgacgtgaccaagggccagttcgagacctacctgcgcgactgccccgacccctgcatcggctgg

SEQ ID NO: 1526 - DNA, 1110 bp, Artificial Sequence
  Description of Artificial Sequence: Synthetic coding sequence
atgcccggccgcagctgcgtggccctggtgctgctggccgccgccgtgagctgcgccgtggcccagcacgcccccccctggaccgaggactgccgcaagagcacctacccccccagcggccccacctaccgcggcgccgtgccctggtacaccatcaacctggacctgcccccctacaagcgctggcacgagctgatgctggacaaggcccccgtgctgaaggtgatcgtgaacagcctgaagaacatgatcaacaccttcgtgcccagcggcaagatcatgcaggtggtggacgagaagctgcccggcctgctgggcaacttccccggccccttcgaggaggagatgaagggcatcgccgccgtgaccgacatccccctgggccacctgatccacggccgcaacatggacttcggcgtgttcctgggctggaacatcaacaacgacacctgggtgatcaccgagcagctgaagcccctgaccgtgaacctggacttccagcgcaacaacaagaccgtgttcaaggccagcagcttcgccggctacgtgggcatgctgaccggcttcaagcccggcctgttcagcctgaccctgaacgagcgcttcagcatcaacggcggctacctgggcatcctggagtggatcctgggcaagaaggacgtgatgtggatcggcttcctgacccgcaccgtgctggagaacagcaccagctacgaggaggccaagaacctgctgaccaagaccaagatcctggcccccgcctacttcatcctgggcggcaaccagagcggcgagggctgcgtgatcacccgcgaccgcaaggagagcctggacgtgtacgagctggacgccaagcagggccgctggtacgtggtgcagaccaactacgaccgctggaagcaccccttcttcctggacgaccgccgcacccccgccaagatgtgcctgaaccgcaccagccaggagaacatcagcttcgagaccatgtacgacgtgctgagcaccaagcccgtgctgaacaagctgaccgtgtacaccaccctgatcgacgtgaccaagggccagttcgagacctacctgcgcgactgccccgacccctgcatcggctgg

SEQ ID NO: 1527 - DNA, 1317 bp, Artificial Sequence
  Description of Artificial Sequence: Synthetic coding sequence
atgcccctgaacgtgagcttcaccaaccgcaactacgacctggactacgacagcgtgcagccctacttctactgcgacgaggaggagaacttctaccagcagcagcagcagagcgagctgcagccccccgcccccagcgaggacatctggaagaagttcgagctgctgcccaccccccccctgagccccagccgccgcagcggcctgtgcagccccagctacgtggccgtgacccccttcagcctgcgcggcgacaacgacggcggcggcggcagcttcagcaccgccgaccagctggagatggtgaccgagctgctgggcggcgacatggtgaaccagagcttcatctgcgaccccgacgacgagaccttcatcaagaacatcatcatccaggactgcatgtggagcggcttcagcgccgccgccaagctggtgagcgagaagctggccagctaccaggccgcccgcaaggacagcggcagccccaaccccgcccgcggccacagcgtgtgcagcaccagcagcctgtacctgcaggacctgagcgccgccgccagcgagtgcatcgaccccagcgtggtgttcccctaccccctgaacgacagcagcagccccaagagctgcgccagccaggacagcagcgccttcagccccagcagcgacagcctgctgagcagcaccgagagcagcccccagggcagccccgagcccctggtgctgcacgaggagaccccccccaccaccagcagcgacagcgaggaggagcaggaggacgaggaggagatcgacgtggtgagcgtggagaagcgccaggcccccggcaagcgcagcgagagcggcagccccagcgccggcggccacagcaagcccccccacagccccctggtgctgaagcgctgccacgtgagcacccaccagcacaactacgccgccccccccagcacccgcaaggactaccccgccgccaagcgcgtgaagctggacagcgtgcgcgtgctgcgccagatcagcaacaaccgcaagtgcaccagcccccgcagcagcgacaccgaggagaacgtgaagcgccgcacccacaacgtgctggagcgccagcgccgcaacgagctgaagcgcagcttcttcgccctgcgcgaccagatccccgagctggagaacaacgagaaggcccccaaggtggtgatcctgaagaaggccaccgcctacatcctgagcgtgcaggccgagacccagaagctgatcagcgagatcgacctgctgcgcaagcagaacgagcagctgaagcacaagctggagcagctgcgcaacagctgcgcc

SEQ ID NO: 1528 - DNA, 270 bp, Artificial Sequence
  Description of Artificial Sequence: Synthetic coding sequence
atgaccgaggagaacgtgaagcgccgcacccacaacgtgctggagcgccagcgccgcaacgagctgaagcgcagcttcttcgccctgcgcgaccagatccccgagctggagaacaacgagaaggcccccaaggtggtgatcctgaagaaggccaccgcctacatcctgagcgtgcaggccgagacccagaagctgatcagcgagatcgacctgctgcgcaagcagaacgagcagctgaagcacaagctggagcagctgcgcaacagctgc

SEQ ID NO: 1529 - DNA, 1062 bp, Artificial Sequence
  Description of Artificial Sequence: Synthetic coding sequence
atgctgttcaacctgcgcatcctgctgaacaacgccgccttccgcaacggccacaacttcatggtgcgcaacttccgctgcggccagcccctgcagaacaaggtgcagctgaagggccgcgacctgctgaccctgaagaacttcaccggcgaggagatcaagtacatgctgtggctgagcgccgacctgaagttccgcatcaagcagaagggcgagtacctgcccctgctgcagggcaagagcctgggcatgatcttcgagaagcgcagcacccgcacccgcctgagcaccgagaccggcttcgccctgctgggcggccacccctgcttcctgaccacccaggacatccacctgggcgtgaacgagagcctgaccgacaccgcccgcgtgctgagcagcatggccgacgccgtgctggcccgcgtgtacaagcagagcgacctggacaccctggccaaggaggccagcatccccatcatcaacggcctgagcgacctgtaccaccccatccagatcctggccgactacctgaccctgcaggagcactacagcagcctgaagggcctgaccctgagctggatcggcgacggcaacaacatcctgcacagcatcatgatgagcgccgccaagttcggcatgcacctgcaggccgccacccccaagggctacgagcccgacgccagcgtgaccaagctggccgagcagtacgccaaggagaacggcaccaagctgctgctgaccaacgaccccctggaggccgcccacggcggcaacgtgctgatcaccgacacctggatcagcatgggccaggaggaggagaagaagaagcgcctgcaggccttccagggctaccaggtgaccatgaagaccgccaaggtggccgccagcgactggaccttcctgcactgcctgccccgcaagcccgaggaggtggacgacgaggtgttctacagcccccgcagcctggtgttccccgaggccgagaaccgcaagtggaccatcatggccgtgatggtgagcctgctgaccgactacagcccccagctgcagaagcccaagttc

SEQ ID NO: 1530 - DNA, 351 bp, Artificial Sequence
  Description of Artificial Sequence: Synthetic coding sequence
atgagcaccgccgtgctggagaaccccggcctgggccgcaagctgagcgacttcggccaggagaccagctacatcgaggacaactgcaaccagaacggcgccatcagcctgatcttcagcctgaaggaggaggtgggcgccctggccaaggtgctgcgcctgttcgaggagaacgacgtgaacctgacccacatcgagagccgccccagccgcctgaagaaggacgagtacgagttcttcacccacctggacaagcgcagcctgcccgccctgaccaacatcatcaagatcctgcgccacgacatcggcgccaccgtgcacgagctgagccgcgacaagaagaaggacacc

SEQ ID NO: 1531 - DNA, 408 bp, Artificial Sequence
  Description of Artificial Sequence: Synthetic coding sequence
atgagcaccgccgtgctggagaaccccggcctgggccgcaagctgagcgacttcggccaggagaccagctacatcgaggacaactgcaaccagaacggcgccatcagcctgatcttcagcctgaaggaggaggtgggcgccctggccaaggtgctgcgcctgttcgaggagaacgacgtgaacctgacccacatcgagagccgccccagccgcctgaagaaggacgagtacgagttcttcacccacctggacaagcgcagcctgcccgccctgaccaacatcatcaagatcctgcgccacgacatcggcgccaccgtgcacgagctgagccgcgacaagaagaaggacaccgtgccctggttcccccgcaccatccaggagctggaccgcttcgccaaccagatcctg

SEQ ID NO: 1532 - DNA, 1356 bp, Artificial Sequence
  Description of Artificial Sequence: Synthetic coding sequence
atgagcaccgccgtgctggagaaccccggcctgggccgcaagctgagcgacttcggccaggagaccagctacatcgaggacaactgcaaccagaacggcgccatcagcctgatcttcagcctgaaggaggaggtgggcgccctggccaaggtgctgcgcctgttcgaggagaacgacgtgaacctgacccacatcgagagccgccccagccgcctgaagaaggacgagtacgagttcttcacccacctggacaagcgcagcctgcccgccctgaccaacatcatcaagatcctgcgccacgacatcggcgccaccgtgcacgagctgagccgcgacaagaagaaggacaccgtgccctggttcccccgcaccatccaggagctggaccgcttcgccaaccagatcctgagctacggcgccgagctggacgccgaccaccccggcttcaaggaccccgtgtaccgcgcccgccgcaagcagttcgccgacatcgcctacaactaccgccacggccagcccatcccccgcgtggagtacatggaggaggagaagaagacctggggcaccgtgttcaagaccctgaagagcctgtacaagacccacgcctgctacgagtacaaccacatcttccccctgctggagaagtactgcggcttccacgaggacaacatcccccagctggaggacgtgagccagttcctgcagacctgcaccggcttccgcctgcgccccgtggccggcctgctgagcagccgcgacttcctgggcggcctggccttccgcgtgttccactgcacccagtacatccgccacggcagcaagcccatgtacacccccgagcccgacatctgccacgagctgctgggccacgtgcccctgttcagcgaccgcagcttcgcccagttcagccaggagatcggcctggccagcctgggcgcccccgacgagtacatcgagaagctggccaccatctactggttcaccgtggagttcggcctgtgcaagcagggcgacagcatcaaggcctacggcgccggcctgctgagcagcttcggcgagctgcagtactgcctgagcgagaagcccaagctgctgcccctggagctggagaagaccgccatccagaactacaccgtgaccgagttccagcccctgtactacgtggccgagagcttcaacgacgccaaggagaaggtgcgcaacttcgccgccaccatcccccgccccttcagcgtgcgctacgacccctacacccagcgcatcgaggtgctggacaacacccagcagctgaagatcctggccgacagcatcaacagcgagatcggcatcctgtgcagcgccctgcagaagatcaag

SEQ ID NO: 1533 - DNA, 2430 bp, Artificial Sequence
  Description of Artificial Sequence: Synthetic coding sequence
atggagcacaaggaggtggtgctgctgctgctgctgttcctgaagagcggccagggcgagcccctggacgactacgtgaacacccagggcgccagcctgttcagcgtgaccaagaagcagctgggcgccggcagcatcgaggagtgcgccgccaagtgcgaggaggacgaggagttcacctgccgcgccttccagtaccacagcaaggagcagcagtgcgtgatcatggccgagaaccgcaagagcagcatcatcatccgcatgcgcgacgtggtgctgttcgagaagaaggtgtacctgagcgagtgcaagaccggcaacggcaagaactaccgcggcaccatgagcaagaccaagaacggcatcacctgccagaagtggagcagcaccagcccccaccgcccccgcttcagccccgccacccaccccagcgagggcctggaggagaactactgccgcaaccccgacaacgacccccagggcccctggtgctacaccaccgaccccgagaagcgctacgactactgcgacatcctggagtgcgaggaggagtgcatgcactgcagcggcgagaactacgacggcaagatcagcaagaccatgagcggcctggagtgccaggcctgggacagccagagcccccacgcccacggctacatccccagcaagttccccaacaagaacctgaagaagaactactgccgcaaccccgaccgcgagctgcgcccctggtgcttcaccaccgaccccaacaagcgctgggagctgtgcgacatcccccgctgcaccacccccccccccagcagcggccccacctaccagtgcctgaagggcaccggcgagaactaccgcggcaacgtggccgtgaccgtgagcggccacacctgccagcactggagcgcccagaccccccacacccacaaccgcacccccgagaacttcccctgcaagaacctggacgagaactactgccgcaaccccgacggcaagcgcgccccctggtgccacaccaccaacagccaggtgcgctgggagtactgcaagatccccagctgcgacagcagccccgtgagcaccgagcagctggcccccaccgccccccccgagctgacccccgtggtgcaggactgctaccacggcgacggccagagctaccgcggcaccagcagcaccaccaccaccggcaagaagtgccagagctggagcagcatgaccccccaccgccaccagaagacccccgagaactaccccaacgccggcctgaccatgaactactgccgcaaccccgacgccgacaagggcccctggtgcttcaccaccgaccccagcgtgcgctgggagtactgcaacctgaagaagtgcagcggcaccgaggccagcgtggtggcccccccccccgtggtgctgctgcccgacgtggagacccccagcgaggaggactgcatgttcggcaacggcaagggctaccgcggcaagcgcgccaccaccgtgaccggcaccccctgccaggactgggccgcccaggagccccaccgccacagcatcttcacccccgagaccaacccccgcgccggcctggagaagaactactgccgcaaccccgacggcgacgtgggcggcccctggtgctacaccaccaacccccgcaagctgtacgactactgcgacgtgccccagtgcgccgcccccagcttcgactgcggcaagccccaggtggagcccaagaagtgccccggccgcgtggtgggcggctgcgtggcccacccccacagctggccctggcaggtgagcctgcgcacccgcttcggcatgcacttctgcggcggcaccctgatcagccccgagtgggtgctgaccgccgcccactgcctggagaagagcccccgccccagcagctacaaggtgatcctgggcgcccaccaggaggtgaacctggagccccacgtgcaggagatcgaggtgagccgcctgttcctggagcccacccgcaaggacatcgccctgctgaagctgagcagccccgccgtgatcaccgacaaggtgatccccgcctgcctgcccagccccaactacgtggtggccgaccgcaccgagtgcttcatcaccggctggggcgagacccagggcaccttcggcgccggcctgctgaaggaggcccagctgcccgtgatcgagaacaaggtgtgcaaccgctacgagttcctgaacggccgcgtgcagagcaccgagctgtgcgccggccacctggccggcggcaccgacagctgccagggcgacagcggcggccccctggtgtgcttcgagaaggacaagtacatcctgcagggcgtgaccagctggggcctgggctgcgcccgccccaacaagcccggcgtgtacgtgcgcgtgagccgcttcgtgacctggatcgagggcgtgatgcgcaacaac

SEQ ID NO: 1534 - DNA, 408 bp, Artificial Sequence
  Description of Artificial Sequence: Synthetic coding sequence
atggagcacaaggaggtggtgctgctgctgctgctgttcctgaagagcggccagggcgagcccctggacgactacgtgaacacccagggcgccagcctgttcagcgtgaccaagaagcagctgggcgccggcagcatcgaggagtgcgccgccaagtgcgaggaggacgaggagttcacctgccgcgccttccagtaccacagcaaggagcagcagtgcgtgatcatggccgagaaccgcaagagcagcatcatcatccgcatgcgcgacgtggtgctgttcgagaagaaggtgtacctgagcgagtgcaagaccggcaacggcaagaactaccgcggcaccatgagcaagaccaagaacggcatcacctgccagaagtggagcagcaccagcccccaccgcccccgc

SEQ ID NO: 1535 - DNA, 1686 bp, Artificial Sequence
  Description of Artificial Sequence: Synthetic coding sequence
atggacgccatgaagcgcggcctgtgctgcgtgctgctgctgtgcggcgccgtgttcgtgagccccagccaggagatccacgcccgcttccgccgcggcgcccgcagctaccaggtgatctgccgcgacgagaagacccagatgatctaccagcagcaccagagctggctgcgccccgtgctgcgcagcaaccgcgtggagtactgctggtgcaacagcggccgcgcccagtgccacagcgtgcccgtgaagagctgcagcgagccccgctgcttcaacggcggcacctgccagcaggccctgtacttcagcgacttcgtgtgccagtgccccgagggcttcgccggcaagtgctgcgagatcgacacccgcgccacctgctacgaggaccagggcatcagctaccgcggcacctggagcaccgccgagagcggcgccgagtgcaccaactggaacagcagcgccctggcccagaagccctacagcggccgccgccccgacgccatccgcctgggcctgggcaaccacaactactgccgcaaccccgaccgcgacagcaagccctggtgctacgtgttcaaggccggcaagtacagcagcgagttctgcagcacccccgcctgcagcgagggcaacagcgactgctacttcggcaacggcagcgcctaccgcggcacccacagcctgaccgagagcggcgccagctgcctgccctggaacagcatgatcctgatcggcaaggtgtacaccgcccagaaccccagcgcccaggccctgggcctgggcaagcacaactactgccgcaaccccgacggcgacgccaagccctggtgccacgtgctgaagaaccgccgcctgacctgggagtactgcgacgtgcccagctgcagcacctgcggcctgcgccagtacagccagccccagttccgcatcaagggcggcctgttcgccgacatcgccagccacccctggcaggccgccatcttcgccaagcaccgccgcagccccggcgagcgcttcctgtgcggcggcatcctgatcagcagctgctggatcctgagcgccgcccactgcttccaggagcgcttccccccccaccacctgaccgtgatcctgggccgcacctaccgcgtggtgcccggcgaggaggagcagaagttcgaggtggagaagtacatcgtgcacaaggagttcgacgacgacacctacgacaacgacatcgccctgctgcagctgaagagcgacagcagccgctgcgcccaggagagcagcgtggtgcgcaccgtgtgcctgccccccgccgacctgcagctgcccgactggaccgagtgcgagctgagcggctacggcaagcacgaggccctgagccccttctacagcgagcgcctgaaggaggcccacgtgcgcctgtaccccagcagccgctgcaccagccagcacctgctgaaccgcaccgtgaccgacaacatgctgtgcgccggcgacacccgcagcggcggcccccaggccaacctgcacgacgcctgccagggcgacagcggcggccccctggtgtgcctgaacgacggccgcatgaccctggtgggcatcatcagctggggcctgggctgcggccagaaggacgtgcccggcgtgtacaccaaggtgaccaactacctggactggatccgcgacaacatgcgcccc

SEQ ID NO: 1536 - DNA, 879 bp, Artificial Sequence
  Description of Artificial Sequence: Synthetic coding sequence
atggacgccatgaagcgcggcctgtgctgcgtgctgctgctgtgcggcgccgtgttcgtgagccccagccaggagatccacgcccgcttccgccgcggcgcccgcagctaccaggtgatctgccgcgacgagaagacccagatgatctaccagcagcaccagagctggctgcgccccgtgctgcgcagcaaccgcgtggagtactgctggtgcaacagcggccgcgcccagtgccacagcgtgcccgtgaagagctgcagcgagccccgctgcttcaacggcggcacctgccagcaggccctgtacttcagcgacttcgtgtgccagtgccccgagggcttcgccggcaagtgctgcgagatcgacacccgcgccacctgctacgaggaccagggcatcagctaccgcggcacctggagcaccgccgagagcggcgccgagtgcaccaactggaacagcagcgccctggcccagaagccctacagcggccgccgccccgacgccatccgcctgggcctgggcaaccacaactactgccgcaaccccgaccgcgacagcaagccctggtgctacgtgttcaaggccggcaagtacagcagcgagttctgcagcacccccgcctgcagcgagggcaacagcgactgctacttcggcaacggcagcgcctaccgcggcacccacagcctgaccgagagcggcgccagctgcctgccctggaacagcatgatcctgatcggcaaggtgtacaccgcccagaaccccagcgcccaggccctgggcctgggcaagcacaactactgccgctgccgcaccggccgcagcgtgagcagccccgccaccgccagcatgcgcccctgcctgctgagcatccgcagcggc

SEQ ID NO: 1537 - DNA, 1548 bp, Artificial Sequence
  Description of Artificial Sequence: Synthetic coding sequence
atggacgccatgaagcgcggcctgtgctgcgtgctgctgctgtgcggcgccgtgttcgtgagccccagccaggagatccacgcccgcttccgccgcggcgcccgcagctaccagggctgcagcgagccccgctgcttcaacggcggcacctgccagcaggccctgtacttcagcgacttcgtgtgccagtgccccgagggcttcgccggcaagtgctgcgagatcgacacccgcgccacctgctacgaggaccagggcatcagctaccgcggcacctggagcaccgccgagagcggcgccgagtgcaccaactggaacagcagcgccctggcccagaagccctacagcggccgccgccccgacgccatccgcctgggcctgggcaaccacaactactgccgcaaccccgaccgcgacagcaagccctggtgctacgtgttcaaggccggcaagtacagcagcgagttctgcagcacccccgcctgcagcgagggcaacagcgactgctacttcggcaacggcagcgcctaccgcggcacccacagcctgaccgagagcggcgccagctgcctgccctggaacagcatgatcctgatcggcaaggtgtacaccgcccagaaccccagcgcccaggccctgggcctgggcaagcacaactactgccgcaaccccgacggcgacgccaagccctggtgccacgtgctgaagaaccgccgcctgacctgggagtactgcgacgtgcccagctgcagcacctgcggcctgcgccagtacagccagccccagttccgcatcaagggcggcctgttcgccgacatcgccagccacccctggcaggccgccatcttcgccaagcaccgccgcagccccggcgagcgcttcctgtgcggcggcatcctgatcagcagctgctggatcctgagcgccgcccactgcttccaggagcgcttccccccccaccacctgaccgtgatcctgggccgcacctaccgcgtggtgcccggcgaggaggagcagaagttcgaggtggagaagtacatcgtgcacaaggagttcgacgacgacacctacgacaacgacatcgccctgctgcagctgaagagcgacagcagccgctgcgcccaggagagcagcgtggtgcgcaccgtgtgcctgccccccgccgacctgcagctgcccgactggaccgagtgcgagctgagcggctacggcaagcacgaggccctgagccccttctacagcgagcgcctgaaggaggcccacgtgcgcctgtaccccagcagccgctgcaccagccagcacctgctgaaccgcaccgtgaccgacaacatgctgtgcgccggcgacacccgcagcggcggcccccaggccaacctgcacgacgcctgccagggcgacagcggcggccccctggtgtgcctgaacgacggccgcatgaccctggtgggcatcatcagctggggcctgggctgcggccagaaggacgtgcccggcgtgtacaccaaggtgaccaactacctggactggatccgcgacaacatgcgcccc

SEQ ID NO: 1538 - DNA, 1308 bp, Artificial Sequence
  Description of Artificial Sequence: Synthetic coding sequence
atggacgccatgaagcgcggcctgtgctgcgtgctgctgctgtgcggcgccgtgttcgtgagccccagccaggagatccacgcccgcttccgccgcggcgcccgcagctaccaggtgatctgccgcgacgagaagacccagatgatctaccagcagcaccagagctggctgcgccccgtgctgcgcagcaaccgcgtggagtactgctggtgcaacagcggccgcgcccagtgccacagcgtgcccgtgaagcgcaacagcgactgctacttcggcaacggcagcgcctaccgcggcacccacagcctgaccgagagcggcgccagctgcctgccctggaacagcatgatcctgatcggcaaggtgtacaccgcccagaaccccagcgcccaggccctgggcctgggcaagcacaactactgccgcaaccccgacggcgacgccaagccctggtgccacgtgctgaagaaccgccgcctgacctgggagtactgcgacgtgcccagctgcagcacctgcggcctgcgccagtacagccagccccagttccgcatcaagggcggcctgttcgccgacatcgccagccacccctggcaggccgccatcttcgccaagcaccgccgcagccccggcgagcgcttcctgtgcggcggcatcctgatcagcagctgctggatcctgagcgccgcccactgcttccaggagcgcttccccccccaccacctgaccgtgatcctgggccgcacctaccgcgtggtgcccggcgaggaggagcagaagttcgaggtggagaagtacatcgtgcacaaggagttcgacgacgacacctacgacaacgacatcgccctgctgcagctgaagagcgacagcagccgctgcgcccaggagagcagcgtggtgcgcaccgtgtgcctgccccccgccgacctgcagctgcccgactggaccgagtgcgagctgagcggctacggcaagcacgaggccctgagccccttctacagcgagcgcctgaaggaggcccacgtgcgcctgtaccccagcagccgctgcaccagccagcacctgctgaaccgcaccgtgaccgacaacatgctgtgcgccggcgacacccgcagcggcggcccccaggccaacctgcacgacgcctgccagggcgacagcggcggccccctggtgtgcctgaacgacggccgcatgaccctggtgggcatcatcagctggggcctgggctgcggccagaaggacgtgcccggcgtgtacaccaaggtgaccaactacctggactggatccgcgacaacatgcgcccc

SEQ ID NO: 1539 - DNA, 1497 bp, Artificial Sequence
  Description of Artificial Sequence: Synthetic coding sequence
atggacgccatgaagcgcggcctgtgctgcgtgctgctgctgtgcggcgccgtgttcgtgagccccagccaggagatccacgcccgcttccgccgcggcgcccgcagctaccaggtgatctgccgcgacgagaagacccagatgatctaccagcagcaccagagctggctgcgccccgtgctgcgcagcaaccgcgtggagtactgctggtgcaacagcggccgcgcccagtgccacagcgtgcccgtgaagagctgcagcgagccccgctgcttcaacggcggcacctgccagcaggccctgtacttcagcgacttcgtgtgccagtgccccgagggcttcgccggcaagtgctgcgagatcgacagcaagccctggtgctacgtgttcaaggccggcaagtacagcagcgagttctgcagcacccccgcctgcagcgagggcaacagcgactgctacttcggcaacggcagcgcctaccgcggcacccacagcctgaccgagagcggcgccagctgcctgccctggaacagcatgatcctgatcggcaaggtgtacaccgcccagaaccccagcgcccaggccctgggcctgggcaagcacaactactgccgcaaccccgacggcgacgccaagccctggtgccacgtgctgaagaaccgccgcctgacctgggagtactgcgacgtgcccagctgcagcacctgcggcctgcgccagtacagccagccccagttccgcatcaagggcggcctgttcgccgacatcgccagccacccctggcaggccgccatcttcgccaagcaccgccgcagccccggcgagcgcttcctgtgcggcggcatcctgatcagcagctgctggatcctgagcgccgcccactgcttccaggagcgcttccccccccaccacctgaccgtgatcctgggccgcacctaccgcgtggtgcccggcgaggaggagcagaagttcgaggtggagaagtacatcgtgcacaaggagttcgacgacgacacctacgacaacgacatcgccctgctgcagctgaagagcgacagcagccgctgcgcccaggagagcagcgtggtgcgcaccgtgtgcctgccccccgccgacctgcagctgcccgactggaccgagtgcgagctgagcggctacggcaagcacgaggccctgagccccttctacagcgagcgcctgaaggaggcccacgtgcgcctgtaccccagcagccgctgcaccagccagcacctgctgaaccgcaccgtgaccgacaacatgctgtgcgccggcgacacccgcagcggcggcccccaggccaacctgcacgacgcctgccagggcgacagcggcggccccctggtgtgcctgaacgacggccgcatgaccctggtgggcatcatcagctggggcctgggctgcggccagaaggacgtgcccggcgtgtacaccaaggtgaccaactacctggactggatccgcgacaacatgcgcccc

SEQ ID NO: 1540 - DNA, 534 bp, Artificial Sequence
  Description of Artificial Sequence: Synthetic coding sequence
atggacgccatgaagcgcggcctgtgctgcgtgctgctgctgtgcggcgccgtgttcgtgagccccagccaggagatccacgcccgcttccgccgcggcgcccgcagctaccaggtgatctgccgcgacgagaagacccagatgatctaccagcagcaccagagctggctgcgccccgtgctgcgcagcaaccgcgtggagtactgctggtgcaacagcggccgcgcccagtgccacagcgtgcccgtgaagagctgcagcgagccccgctgcttcaacggcggcacctgccagcaggccctgtacttcagcgacttcgtgtgccagtgccccgagggcttcgccggcaagtgctgcgagatcgacacccgcgccacctgctacgaggaccagggcatcagctaccgcggcacctggagcaccgccgagagcggcgccgagtgcaccaactggaacagcagcgccctggcccagaagccctacagcggccgccgccccgacgccatccgcctgggcctgggcaaccacaactac

SEQ ID NO: 1541 - DNA, 471 bp, Artificial Sequence
  Description of Artificial Sequence: Synthetic coding sequence
atggacgccatgaagcgcggcctgtgctgcgtgctgctgctgtgcggcgccgtgttcgtgagccccagccaggagatccacgcccgcttccgccgcggcgcccgcagctaccaggtgatctgccgcgacgagaagacccagatgatctaccagcagcaccagagctggctgcgccccgtgctgcgcagcaaccgcgtggagtactgctggtgcaacagcggccgcgcccagtgccacagcgtgcccgtgaagagctgcagcgagccccgctgcttcaacggcggcacctgccagcaggccctgtacttcagcgacttcgtgtgccagtgccccgagggcttcgccggcaagtgctgcgagatcgacacccgcgccacctgctacgaggaccagggcatcagctaccgcggcacctggagcaccgccgagagcggcgccgagtgcaccaactggaacagcagcgccctggcc

SEQ ID NO: 1542 - DNA, 1419 bp, Artificial Sequence
  Description of Artificial Sequence: Synthetic coding sequence
atggacgccatgaagcgcggcctgtgctgcgtgctgctgctgtgcggcgccgtgttcgtgagccccagccaggagatccacgcccgcttccgccgcggcgcccgcagctaccaggtgatctgccgcgacgagaagacccagatgatctaccagcagcaccagagctggctgcgccccgtgctgcgcagcaaccgcgtggagtactgctggtgcaacagcggccgcgcccagtgccacagcgtgcccgtgaagagctgcagcgagccccgctgcttcaacggcggcacctgccagcaggccctgtacttcagcgacttcgtgtgccagtgccccgagggcttcgccggcaagtgctgcgagatcggcaacagcgactgctacttcggcaacggcagcgcctaccgcggcacccacagcctgaccgagagcggcgccagctgcctgccctggaacagcatgatcctgatcggcaaggtgtacaccgcccagaaccccagcgcccaggccctgggcctgggcaagcacaactactgccgcaaccccgacggcgacgccaagccctggtgccacgtgctgaagaaccgccgcctgacctgggagtactgcgacgtgcccagctgcagcacctgcggcctgcgccagtacagccagccccagttccgcatcaagggcggcctgttcgccgacatcgccagccacccctggcaggccgccatcttcgccaagcaccgccgcagccccggcgagcgcttcctgtgcggcggcatcctgatcagcagctgctggatcctgagcgccgcccactgcttccaggagcgcttccccccccaccacctgaccgtgatcctgggccgcacctaccgcgtggtgcccggcgaggaggagcagaagttcgaggtggagaagtacatcgtgcacaaggagttcgacgacgacacctacgacaacgacatcgccctgctgcagctgaagagcgacagcagccgctgcgcccaggagagcagcgtggtgcgcaccgtgtgcctgccccccgccgacctgcagctgcccgactggaccgagtgcgagctgagcggctacggcaagcacgaggccctgagccccttctacagcgagcgcctgaaggaggcccacgtgcgcctgtaccccagcagccgctgcaccagccagcacctgctgaaccgcaccgtgaccgacaacatgctgtgcgccggcgacacccgcagcggcggcccccaggccaacctgcacgacgcctgccagggcgacagcggcggccccctggtgtgcctgaacgacggccgcatgaccctggtgggcatcatcagctggggcctgggctgcggccagaaggacgtgcccggcgtgtacaccaaggtgaccaactacctggactggatccgcgacaacatgcgcccc

SEQ ID NO: 1543 - DNA, 870 bp, Artificial Sequence
  Description of Artificial Sequence: Synthetic coding sequence
atgatcgagaccgacagcggcgtggacgacgacatggcctgccacaagatccccgtggaggccgacttcctgtacgcctacagcaccgcccccggctactacagctggcgcaacagcaaggacggcagctggttcatccagagcctgtgcgccatgctgaagcagtacgccgacaagctggagttcatgcacatcctgacccgcgtgaaccgcaaggtggccaccgagttcgagagcttcagcttcgacgccaccttccacgccaagaagcagatcccctgcatcgtgagcatgctgaccaaggagctgtacttctaccacgacgaggtggacggcggcagccccatggagaacaccgagaacagcgtggacagcaagagcatcaagaacctggagcccaagatcatccacggcagcgagagcatggacagcggcatcagcctggacaacagctacaagatggactaccccgagatgggcctgtgcatcatcatcaacaacaagaacttccacaagagcaccggcatgaccagccgcagcggcaccgacgtggacgccgccaacctgcgcgagaccttccgcaacctgaagtacgaggtgcgcaacaagaacgacctgacccgcgaggagatcgtggagctgatgcgcgacgtgagcaaggaggaccacagcaagcgcagcagcttcgtgtgcgtgctgctgagccacggcgaggagggcatcatcttcggcaccaacggccccgtggacctgaagaagatcaccaacttcttccgcggcgaccgctgccgcagcctgaccggcaagcccaagctgttcatcatccaggcctgccgcggcaccgagctggactgcggcatcgagaccgac

SEQ ID NO: 1544 - DNA, 855 bp, Artificial Sequence
  Description of Artificial Sequence: Synthetic coding sequence
atgatcgagaccgacagcggcgtggacgacgacatggcctgccacaagatccccgtggaggccgacttcctgtacgcctacagcaccgcccccggctactacagctggcgcaacagcaaggacggcagctggttcatccagagcctgtgcgccatgctgaagcagtacgccgacaagctggagttcatgcacatcctgacccgcgtgaaccgcaaggtggccaccgagttcgagagcttcagcttcgacgccaccttccacgccaagaagcagatcccctgcatcgtgagcatgctgaccaaggagctgtacttctaccacggcagccccatggagaacaccgagaacagcgtggccagcaagagcatcaagaacctggagcccaagatcatccacggcagcgagagcatggccagcggcatcagcctggacaacagctacaagatggactaccccgagatgggcctgtgcatcatcatcaacaacaagaacttccacaagagcaccggcatgaccagccgcagcggcaccgacgtggacgccgccaacctgcgcgagaccttccgcaacctgaagtacgaggtgcgcaacaagaacgacctgacccgcgaggagatcgtggagctgatgcgcgacgtgagcaaggaggaccacagcaagcgcagcagcttcgtgtgcgtgctgctgagccacggcgaggagggcatcatcttcggcaccaacggccccgtggacctgaagaagatcaccaacttcttccgcggcgaccgctgccgcagcctgaccggcaagcccaagctgttcatcatccaggcctgccgcggcaccgagctggactgcggcatcgagaccgac

SEQ ID NO: 1545 - DNA, 900 bp, Artificial Sequence
  Description of Artificial Sequence: Synthetic coding sequence
atggtggagatcgacgccgccagcgtgtacaccctgcccgccggcgccgacttcctgatgtgctacagcgtggccgagggctactacagccaccgcgagaccgtgaacggcagctggtacatccaggacctgtgcgagatgctgggcaagtacggcagcagcctggagttcaccgagctgctgaccctggtgaaccgcaaggtgagccagcgccgcgtggacttctgcaaggaccccagcgccatcggcaagaagcaggtgccctgcttcgccagcatgctgaccaagaagctgcacttcttccccaagagcaacctggagcaccaccaccaccaccacgtggagatcgacggcggcagccccatgagcagcgccagcggcctgcgccgcggccaccccgccggcggcgaggagaacatgaccgagaccgacgccttctacaagcgcgagatgttcgaccccgccgagaagtacaagatggaccaccgccgccgcggcatcgccctgatcttcaaccacgagcgcttcttctggcacctgaccctgcccgagcgccgcggcacctgcgccgaccgcgacaacctgacccgccgcttcagcgacctgggcttcgaggtgaagtgcttcaacgacctgaaggccgaggagctgctgctgaagatccacgaggtgagcaccgtgagccacgccgacgccgactgcttcgtgtgcgtgttcctgagccacggcgagggcaaccacatctacgcctacgacgccaagatcgagatccagaccctgaccggcctgttcaagggcgacaagtgccacagcctggtgggcaagcccaagatcttcatcatccaggcctgccgcggcaaccagcacgacgtgcccgtgatccccctggacgtggtggac

SEQ ID NO: 1546 - DNA, 1392 bp, Artificial Sequence
  Description of Artificial Sequence: Synthetic coding sequence
atgtacagcaacgtgatcggcaccgtgaccagcggcaagcgcaaggtgtacctgctgagcctgctgctgatcggcttctgggactgcgtgacctgccacggcagccccgtggacatctgcaccgccaagccccgcgacatccccatgaaccccatgtgcatctaccgcagccccgagaagaaggccaccgaggacgagggcagcgagcagaagatccccgaggccaccaaccgccgcgtgtgggagctgagcaaggccaacagccgcttcgccaccaccttctaccagcacctggccgacagcaagaacgacaacgacaacatcttcctgagccccctgagcatcagcaccgccttcgccatgaccaagctgggcgcctgcaacgacaccctgcagcagctgatggaggtgttcaagttcgacaccatcagcgagaagaccagcgaccagatccacttcttcttcgccaagctgaactgccgcctgtaccgcaaggccaacaagagcagcaagctggtgagcgccaaccgcctgttcggcgacaagagcctgaccttcaacgagacctaccaggacatcagcgagctggtgtacggcgccaagctgcagcccctggacttcaaggagaacgccgagcagagccgcgccgccatcaacaagtgggtgagcaacaagaccgagggccgcatcaccgacgtgatccccagcgaggccatcaacgagctgaccgtgctggtgctggtgaacaccatctacttcaagggcctgtggaagagcaagttcagccccgagaacacccgcaaggagctgttctacaaggccgacggcgagagctgcagcgccagcatgatgtaccaggagggcaagttccgctaccgccgcgtggccgagggcacccaggtgctggagctgcccttcaagggcgacgacatcaccatggtgctgatcctgcccaagcccgagaagagcctggccaaggtggagaaggagctgacccccgaggtgctgcaggagtggctggacgagctggaggagatgatgctggtggtgcacatgccccgcttccgcatcgaggacggcttcagcctgaaggagcagctgcaggacatgggcctggtggacctgttcagccccgagaagagcaagctgcccggcatcgtggccgagggccgcgacgacctgtacgtgagcgacgccttccacaaggccttcctggaggtgaacgaggagggcagcgaggccgccgccagcaccgccgtggtgatcgccggccgcagcctgaaccccaaccgcgtgaccttcaaggccaaccgccccttcctggtgttcatccgcgaggtgcccctgaacaccatcatcttcatgggccgcgtggccaacccctgcgtgaag

SEQ ID NO: 1547 - DNA, 1473 bp, Artificial Sequence
  Description of Artificial Sequence: Synthetic coding sequence
atggccctgctgtggggcctgctggtgctgagctggagctgcctgcagggcccctgcagcgtgttcagccccgtgagcgccatggagcccctgggccgccagctgaccagcggccccaaccaggagcaggtgagccccctgaccctgctgaagctgggcaaccaggagcccggcggccagaccgccctgaagagcccccccggcgtgtgcagccgcgaccccacccccgagcagacccaccgcctggcccgcgccatgatggccttcaccgccgacctgttcagcctggtggcccagaccagcacctgccccaacctgatcctgagccccctgagcgtggccctggccctgagccacctggccctgggcgcccagaaccacaccctgcagcgcctgcagcaggtgctgcacgccggcagcggcccctgcctgccccacctgctgagccgcctgtgccaggacctgggccccggcgccttccgcctggccgcccgcatgtacctgcagaagggcttccccatcaaggaggacttcctggagcagagcgagcagctgttcggcgccaagcccgtgagcctgaccggcaagcaggaggacgacctggccaacatcaaccagtgggtgaaggaggccaccgagggcaagatccaggagttcctgagcggcctgcccgaggacaccgtgctgctgctgctgaacgccatccacttccagggcttctggcgcaacaagttcgaccccagcctgacccagcgcgacagcttccacctggacgagcagttcaccgtgcccgtggagatgatgcaggcccgcacctaccccctgcgctggttcctgctggagcagcccgagatccaggtggcccacttccccttcaagaacaacatgagcttcgtggtgctggtgcccacccacttcgagtggaacgtgagccaggtgctggccaacctgagctgggacaccctgcacccccccctggtgtgggagcgccccaccaaggtgcgcctgcccaagctgtacctgaagcaccagatggacctggtggccaccctgagccagctgggcctgcaggagctgttccaggcccccgacctgcgcggcatcagcgagcagagcctggtggtgagcggcgtgcagcaccagagcaccctggagctgagcgaggtgggcgtggaggccgccgccgccaccagcatcgccatgagccgcatgagcctgagcagcttcagcgtgaaccgccccttcctgttcttcatcttcgaggacaccaccggcctgcccctgttcgtgggcagcgtgcgcaaccccaaccccagcgccccccgcgagctgaaggagcagcaggacagccccggcaacaaggacttcctgcagagcctgaagggcttcccccgcggcgacaagctgttcggccccgacctgaagctggtgccccccatggaggaggactacccccagttcggcagccccaag

SEQ ID NO: 1548 - DNA, 1281 bp, Artificial Sequence
  Description of Artificial Sequence: Synthetic coding sequence
atggccctgctgtggggcctgctggtgctgagctggagctgcctgcagggcccctgcagcgtgttcagccccgtgagcgccatggagcccctgggccgccagctgaccagcggccccaaccaggagcaggtgagccccctgaccctgctgaagctgggcaaccaggtgcagcccggcgcccagaaccacaccctgcagcgcctgcagcaggtgctgcacgccggcagcggcccctgcctgccccacctgctgagccgcctgtgccaggacctgggccccggcgccttccgcctggccgcccgcatgtacctgcagaagggcttccccatcaaggaggacttcctggagcagagcgagcagctgttcggcgccaagcccgtgagcctgaccggcaagcaggaggacgacctggccaacatcaaccagtgggtgaaggaggccaccgagggcaagatccaggagttcctgagcggcctgcccgaggacaccgtgctgctgctgctgaacgccatccacttccagggcttctggcgcaacaagttcgaccccagcctgacccagcgcgacagcttccacctggacgagcagttcaccgtgcccgtggagatgatgcaggcccgcacctaccccctgcgctggttcctgctggagcagcccgagatccaggtggcccacttccccttcaagaacaacatgagcttcgtggtgctggtgcccacccacttcgagtggaacgtgagccaggtgctggccaacctgagctgggacaccctgcacccccccctggtgtgggagcgccccaccaaggtgcgcctgcccaagctgtacctgaagcaccagatggacctggtggccaccctgagccagctgggcctgcaggagctgttccaggcccccgacctgcgcggcatcagcgagcagagcctggtggtgagcggcgtgcagcaccagagcaccctggagctgagcgaggtgggcgtggaggccgccgccgccaccagcatcgccatgagccgcatgagcctgagcagcttcagcgtgaaccgccccttcctgttcttcatcttcgaggacaccaccggcctgcccctgttcgtgggcagcgtgcgcaaccccaaccccagcgccccccgcgagctgaaggagcagcaggacagccccggcaacaaggacttcctgcagagcctgaagggcttcccccgcggcgacaagctgttcggccccgacctgaagctggtgccccccatggaggaggactacccccagttcggcagccccaag

SEQ ID NO: 1549 - DNA, 765 bp, Artificial Sequence
  Description of Artificial Sequence: Synthetic coding sequence
atggccctgctgtggggcctgctggtgctgagctggagctgcctgcagggcccctgcagcgtgttcagccccgtgagcgccatggagcccctgggccgccagctgaccagcggccccaaccaggagcaggtgagccccctgaccctgctgaagctgggcaaccaggagcccggcggccagaccgccctgaagagcccccccggcgtgtgcagccgcgaccccacccccgagcagacccaccgcctggcccgcgccatgatggccttcaccgccgacctgttcagcctggtggcccagaccagcacctgccccaacctgatcctgagccccctgagcgtggccctggccctgagccacctggccctgggcgcccagaaccacaccctgcagcgcctgcagcaggtgctgcacgccggcagcggcccctgcctgccccacctgctgagccgcctgtgccaggacctgggccccggcgccttccgcctggccgcccgcatgtacctgcagaagggcttccccatcaaggaggacttcctggagcagagcgagcagctgttcggcgccaagcccgtgagcctgaccggcaagcaggaggacgacctggccaacatcaaccagtgggtgaaggaggccaccgagggcaagatccaggagttcctgagcggcctgcccgaggacaccgtgctgctgctgctgaacgccatccacttccagggcttctggcgcaacaagttcgaccccagcctgacccagcgcgacagcttc

SEQ ID NO: 1550 - DNA, 1500 bp, Artificial Sequence
  Description of Artificial Sequence: Synthetic coding sequence
atggccagccgcctgaccctgctgaccctgctgctgctgctgctggccggcgaccgcgccagcagcaaccccaacgccaccagcagcagcagccaggaccccgagagcctgcaggaccgcggcgagggcaaggtggccaccaccgtgatcagcaagatgctgttcgtggagcccatcctggaggtgagcagcctgcccaccaccaacagcaccaccaacagcgccaccaagatcaccgccaacaccaccgacgagcccaccacccagcccaccaccgagcccaccacccagcccaccatccagcccacccagcccaccacccagctgcccaccgacagccccacccagcccaccaccggcagcttctgccccggccccgtgaccctgtgcagcgacctggagagccacagcaccgaggccgtgctgggcgacgccctggtggacttcagcctgaagctgtaccacgccttcagcgccatgaagaaggtggagaccaacatggccttcagccccttcagcatcgccagcctgctgacccaggtgctgctgggcgccggcgagaacaccaagaccaacctggagagcatcctgagctaccccaaggacttcacctgcgtgcaccaggccctgaagggcttcaccaccaagggcgtgaccagcgtgagccagatcttccacagccccgacctggccatccgcgacaccttcgtgaacgccagccgcaccctgtacagcagcagcccccgcgtgctgagcaacaacagcgacgccaacctggagctgatcaacacctgggtggccaagaacaccaacaacaagatcagccgcctgctggacagcctgcccagcgacacccgcctggtgctgctgaacgccatctacctgagcgccaagtggaagaccaccttcgaccccaagaagacccgcatggagcccttccacttcaagaacagcgtgatcaaggtgcccatgatgaacagcaagaagtaccccgtggcccacttcatcgaccagaccctgaaggccaaggtgggccagctgcagctgagccacaacctgagcctggtgatcctggtgccccagaacctgaagcaccgcctggaggacatggagcaggccctgagccccagcgtgttcaaggccatcatggagaagctggagatgagcaagttccagcccaccctgctgaccctgccccgcatcaaggtgaccaccagccaggacatgctgagcatcatggagaagctggagttcttcgacttcagctacgacctgaacctgtgcggcctgaccgaggaccccgacctgcaggtgagcgccatgcagcaccagaccgtgctggagctgaccgagaccggcgtggaggccgccgccgccagcgccatcagcgtggcccgcaccctgctggtgttcgaggtgcagcagcccttcctgttcgtgctgtgggaccagcagcacaagttccccgtgttcatgggccgcgtgtacgacccccgcgcc

SEQ ID NO: 1551 - DNA, 1515 bp, Artificial Sequence
  Description of Artificial Sequence: Synthetic coding sequence
atggccagccgcctgaccctgctgaccctgctgctgctgctgctggccggcttcctggagccccaggaccgcgccagcagcaaccccaacgccaccagcagcagcagccaggaccccgagagcctgcaggaccgcggcgagggcaaggtggccaccaccgtgatcagcaagatgctgttcgtggagcccatcctggaggtgagcagcctgcccaccaccaacagcaccaccaacagcgccaccaagatcaccgccaacaccaccgacgagcccaccacccagcccaccaccgagcccaccacccagcccaccatccagcccacccagcccaccacccagctgcccaccgacagccccacccagcccaccaccggcagcttctgccccggccccgtgaccctgtgcagcgacctggagagccacagcaccgaggccgtgctgggcgacgccctggtggacttcagcctgaagctgtaccacgccttcagcgccatgaagaaggtggagaccaacatggccttcagccccttcagcatcgccagcctgctgacccaggtgctgctgggcgccggcgagaacaccaagaccaacctggagagcatcctgagctaccccaaggacttcacctgcgtgcaccaggccctgaagggcttcaccaccaagggcgtgaccagcgtgagccagatcttccacagccccgacctggccatccgcgacaccttcgtgaacgccagccgcaccctgtacagcagcagcccccgcgtgctgagcaacaacagcgacgccaacctggagctgatcaacacctgggtggccaagaacaccaacaacaagatcagccgcctgctggacagcctgcccagcgacacccgcctggtgctgctgaacgccatctacctgagcgccaagtggaagaccaccttcgaccccaagaagacccgcatggagcccttccacttcaagaacagcgtgatcaaggtgcccatgatgaacagcaagaagtaccccgtggcccacttcatcgaccagaccctgaaggccaaggtgggccagctgcagctgagccacaacctgagcctggtgatcctggtgccccagaacctgaagcaccgcctggaggacatggagcaggccctgagccccagcgtgttcaaggccatcatggagaagctggagatgagcaagttccagcccaccctgctgaccctgccccgcatcaaggtgaccaccagccaggacatgctgagcatcatggagaagctggagttcttcgacttcagctacgacctgaacctgtgcggcctgaccgaggaccccgacctgcaggtgagcgccatgcagcaccagaccgtgctggagctgaccgagaccggcgtggaggccgccgccgccagcgccatcagcgtggcccgcaccctgctggtgttcgaggtgcagcagcccttcctgttcgtgctgtgggaccagcagcacaagttccccgtgttcatgggccgcgtgtacgacccccgcgcc

SEQ ID NO: 1552 - DNA, 1344 bp, Artificial Sequence
  Description of Artificial Sequence: Synthetic coding sequence
atgctgttcgtggagcccatcctggaggtgagcagcctgcccaccaccaacagcaccaccaacagcgccaccaagatcaccgccaacaccaccgacgagcccaccacccagcccaccaccgagcccaccacccagcccaccatccagcccacccagcccaccacccagctgcccaccgacagccccacccagcccaccaccggcagcttctgccccggccccgtgaccctgtgcagcgacctggagagccacagcaccgaggccgtgctgggcgacgccctggtggacttcagcctgaagctgtaccacgccttcagcgccatgaagaaggtggagaccaacatggccttcagccccttcagcatcgccagcctgctgacccaggtgctgctgggcgccggcgagaacaccaagaccaacctggagagcatcctgagctaccccaaggacttcacctgcgtgcaccaggccctgaagggcttcaccaccaagggcgtgaccagcgtgagccagatcttccacagccccgacctggccatccgcgacaccttcgtgaacgccagccgcaccctgtacagcagcagcccccgcgtgctgagcaacaacagcgacgccaacctggagctgatcaacacctgggtggccaagaacaccaacaacaagatcagccgcctgctggacagcctgcccagcgacacccgcctggtgctgctgaacgccatctacctgagcgccaagtggaagaccaccttcgaccccaagaagacccgcatggagcccttccacttcaagaacagcgtgatcaaggtgcccatgatgaacagcaagaagtaccccgtggcccacttcatcgaccagaccctgaaggccaaggtgggccagctgcagctgagccacaacctgagcctggtgatcctggtgccccagaacctgaagcaccgcctggaggacatggagcaggccctgagccccagcgtgttcaaggccatcatggagaagctggagatgagcaagttccagcccaccctgctgaccctgccccgcatcaaggtgaccaccagccaggacatgctgagcatcatggagaagctggagttcttcgacttcagctacgacctgaacctgtgcggcctgaccgaggaccccgacctgcaggtgagcgccatgcagcaccagaccgtgctggagctgaccgagaccggcgtggaggccgccgccgccagcgccatcagcgtggcccgcaccctgctggtgttcgaggtgcagcagcccttcctgttcgtgctgtgggaccagcagcacaagttccccgtgttcatgggccgcgtgtacgacccccgcgcc

SEQ ID NO: 1553 - DNA, 480 bp, Artificial Sequence
  Description of Artificial Sequence: Synthetic coding sequence
atggccagccgcctgaccctgctgaccctgctgctgctgctgctggccggcgaccgcgccagcagcaaccccaacgccaccagcagcagcagccaggaccccgagagcctgcaggaccgcggcgagggcaaggtggccaccaccgtgatcagcaagatgctgttcgtggagcccatcctggaggtgagcagcctgcccaccaccaacagcaccaccaacagcgccaccaagatcaccgccaacaccaccgacgagcccaccacccagcccaccaccgagcccaccacccagcccaccatccagcccacccagcccaccacccagctgcccaccgacagccccacccagcccaccaccggcagcttctgccccggccccgtgaccctgtgcagcgacctggagagccacagcaccgaggccgtgctgggcgacgccctggtggacttcagcctgaagctgtaccacgccttcagcgccatg

SEQ ID NO: 1554 - DNA, 2241 bp, Artificial Sequence
  Description of Artificial Sequence: Synthetic coding sequence
atggccgacgaggccgccctggccctgcagcccggcggcagccccagcgccgccggcgccgaccgcgaggccgccagcagccccgccggcgagcccctgcgcaagcgcccccgccgcgacggccccggcctggagcgcagccccggcgagcccggcggcgccgcccccgagcgcgaggtgcccgccgccgcccgcggctgccccggcgccgccgccgccgccctgtggcgcgaggccgaggccgaggccgccgccgccggcggcgagcaggaggcccaggccaccgccgccgccggcgagggcgacaacggccccggcctgcagggccccagccgcgagccccccctggccgacaacctgtacgacgaggacgacgacgacgagggcgaggaggaggaggaggccgccgccgccgccatcggctaccgcgacaacctgctgttcggcgacgagatcatcaccaacggcttccacagctgcgagagcgacgaggaggaccgcgccagccacgccagcagcagcgactggaccccccgcccccgcatcggcccctacaccttcgtgcagcagcacctgatgatcggcaccgacccccgcaccatcctgaaggacctgctgcccgagaccatccccccccccgagctggacgacatgaccctgtggcagatcgtgatcaacatcctgagcgagccccccaagcgcaagaagcgcaaggacatcaacaccatcgaggacgccgtgaagctgctgcaggagtgcaagaagatcatcgtgctgaccggcgccggcgtgagcgtgagctgcggcatccccgacttccgcagccgcgacggcatctacgcccgcctggccgtggacttccccgacctgcccgacccccaggccatgttcgacatcgagtacttccgcaaggacccccgccccttcttcaagttcgccaaggagatctaccccggccagttccagcccagcctgtgccacaagttcatcgccctgagcgacaaggagggcaagctgctgcgcaactacacccagaacatcgacaccctggagcaggtggccggcatccagcgcatcatccagtgccacggcagcttcgccaccgccagctgcctgatctgcaagtacaaggtggactgcgaggccgtgcgcggcgacatcttcaaccaggtggtgccccgctgcccccgctgccccgccgacgagcccctggccatcatgaagcccgagatcgtgttcttcggcgagaacctgcccgagcagttccaccgcgccatgaagtacgacaaggacgaggtggacctgctgatcgtgatcggcagcagcctgaaggtgcgccccgtggccctgatccccagcagcatcccccacgaggtgccccagatcctgatcaaccgcgagcccctgccccacctgcacttcgacgtggagctgctgggcgactgcgacgtgatcatcaacgagctgtgccaccgcctgggcggcgagtacgccaagctgtgctgcaaccccgtgaagctgagcgagatcaccgagaagcccccccgcacccagaaggagctggcctacctgagcgagctgccccccacccccctgcacgtgagcgaggacagcagcagccccgagcgcaccagcccccccgacagcagcgtgatcgtgaccctgctggaccaggccgccaagagcaacgacgacctggacgtgagcgagagcaagggctgcatggaggagaagccccaggaggtgcagaccagccgcaacgtggagagcatcgccgagcagatggagaaccccgacctgaagaacgtgggcagcagcaccggcgagaagaacgagcgcaccagcgtggccggcaccgtgcgcaagtgctggcccaaccgcgtggccaaggagcagatcagccgccgcctggacggcaaccagtacctgttcctgccccccaaccgctacatcttccacggcgccgaggtgtacagcgacagcgaggacgacgtgctgagcagcagcagctgcggcagcaacagcgacagcggcacctgccagagccccagcctggaggagcccatggaggacgagagcgagatcgaggagttctacaacggcctggaggacgagcccgacgtgcccgagcgcgccggcggcgccggcttcggcaccgacggcgacgaccaggaggccatcaacgaggccatcagcgtgaagcaggaggtgaccgacatgaactaccccagcaacaagagc

SEQ ID NO: 1555 - DNA, 1332 bp, Artificial Sequence
  Description of Artificial Sequence: Synthetic coding sequence
atgtgcctgtgcagcggccgcaagaccatcctggagatctaccccggccagttccagcccagcctgtgccacaagttcatcgccctgagcgacaaggagggcaagctgctgcgcaactacacccagaacatcgacaccctggagcaggtggccggcatccagcgcatcatccagtgccacggcagcttcgccaccgccagctgcctgatctgcaagtacaaggtggactgcgaggccgtgcgcggcgacatcttcaaccaggtggtgccccgctgcccccgctgccccgccgacgagcccctggccatcatgaagcccgagatcgtgttcttcggcgagaacctgcccgagcagttccaccgcgccatgaagtacgacaaggacgaggtggacctgctgatcgtgatcggcagcagcctgaaggtgcgccccgtggccctgatccccagcagcatcccccacgaggtgccccagatcctgatcaaccgcgagcccctgccccacctgcacttcgacgtggagctgctgggcgactgcgacgtgatcatcaacgagctgtgccaccgcctgggcggcgagtacgccaagctgtgctgcaaccccgtgaagctgagcgagatcaccgagaagcccccccgcacccagaaggagctggcctacctgagcgagctgccccccacccccctgcacgtgagcgaggacagcagcagccccgagcgcaccagcccccccgacagcagcgtgatcgtgaccctgctggaccaggccgccaagagcaacgacgacctggacgtgagcgagagcaagggctgcatggaggagaagccccaggaggtgcagaccagccgcaacgtggagagcatcgccgagcagatggagaaccccgacctgaagaacgtgggcagcagcaccggcgagaagaacgagcgcaccagcgtggccggcaccgtgcgcaagtgctggcccaaccgcgtggccaaggagcagatcagccgccgcctggacggcaaccagtacctgttcctgccccccaaccgctacatcttccacggcgccgaggtgtacagcgacagcgaggacgacgtgctgagcagcagcagctgcggcagcaacagcgacagcggcacctgccagagccccagcctggaggagcccatggaggacgagagcgagatcgaggagttctacaacggcctggaggacgagcccgacgtgcccgagcgcgccggcggcgccggcttcggcaccgacggcgacgaccaggaggccatcaacgaggccatcagcgtgaagcaggaggtgaccgacatgaactaccccagcaacaagagc

SEQ ID NO: 1556 - DNA, 1356 bp, Artificial Sequence
  Description of Artificial Sequence: Synthetic coding sequence
atgttcgacatcgagtacttccgcaaggacccccgccccttcttcaagttcgccaaggagatctaccccggccagttccagcccagcctgtgccacaagttcatcgccctgagcgacaaggagggcaagctgctgcgcaactacacccagaacatcgacaccctggagcaggtggccggcatccagcgcatcatccagtgccacggcagcttcgccaccgccagctgcctgatctgcaagtacaaggtggactgcgaggccgtgcgcggcgacatcttcaaccaggtggtgccccgctgcccccgctgccccgccgacgagcccctggccatcatgaagcccgagatcgtgttcttcggcgagaacctgcccgagcagttccaccgcgccatgaagtacgacaaggacgaggtggacctgctgatcgtgatcggcagcagcctgaaggtgcgccccgtggccctgatccccagcagcatcccccacgaggtgccccagatcctgatcaaccgcgagcccctgccccacctgcacttcgacgtggagctgctgggcgactgcgacgtgatcatcaacgagctgtgccaccgcctgggcggcgagtacgccaagctgtgctgcaaccccgtgaagctgagcgagatcaccgagaagcccccccgcacccagaaggagctggcctacctgagcgagctgccccccacccccctgcacgtgagcgaggacagcagcagccccgagcgcaccagcccccccgacagcagcgtgatcgtgaccctgctggaccaggccgccaagagcaacgacgacctggacgtgagcgagagcaagggctgcatggaggagaagccccaggaggtgcagaccagccgcaacgtggagagcatcgccgagcagatggagaaccccgacctgaagaacgtgggcagcagcaccggcgagaagaacgagcgcaccagcgtggccggcaccgtgcgcaagtgctggcccaaccgcgtggccaaggagcagatcagccgccgcctggacggcaaccagtacctgttcctgccccccaaccgctacatcttccacggcgccgaggtgtacagcgacagcgaggacgacgtgctgagcagcagcagctgcggcagcaacagcgacagcggcacctgccagagccccagcctggaggagcccatggaggacgagagcgagatcgaggagttctacaacggcctggaggacgagcccgacgtgcccgagcgcgccggcggcgccggcttcggcaccgacggcgacgaccaggaggccatcaacgaggccatcagcgtgaagcaggaggtgaccgacatgaactaccccagcaacaagagc

SEQ ID NO: 1557 - DNA, 984 bp, Artificial Sequence
  Description of Artificial Sequence: Synthetic coding sequence
atgagcgtgaactacgccgccggcctgagcccctacgccgacaagggcaagtgcggcctgcccgagatcttcgacccccccgaggagctggagcgcaaggtgtgggagctggcccgcctggtgtggcagagcagcagcgtggtgttccacaccggcgccggcatcagcaccgccagcggcatccccgacttccgcggcccccacggcgtgtggaccatggaggagcgcggcctggcccccaagttcgacaccaccttcgagagcgcccgccccacccagacccacatggccctggtgcagctggagcgcgtgggcctgctgcgcttcctggtgagccagaacgtggacggcctgcacgtgcgcagcggcttcccccgcgacaagctggccgagctgcacggcaacatgttcgtggaggagtgcgccaagtgcaagacccagtacgtgcgcgacaccgtggtgggcaccatgggcctgaaggccaccggccgcctgtgcaccgtggccaaggcccgcggcctgcgcgcctgccgcaacgccgacctgagcatcaccctgggcaccagcctgcagatccgccccagcggcaacctgcccctggccaccaagcgccgcggcggccgcctggtgatcgtgaacctgcagcccaccaagcacgaccgccacgccgacctgcgcatccacggctacgtggacgaggtgatgacccgcctgatgaagcacctgggcctggagatccccgcctgggacggcccccgcgtgctggagcgcgccctgccccccctgccccgcccccccacccccaagctggagcccaaggaggagagccccacccgcatcaacggcagcatccccgccggccccaagcaggagccctgcgcccagcacaacggcagcgagcccgccagccccaagcgcgagcgccccaccagccccgccccccaccgcccccccaagcgcgtgaaggccaaggccgtgcccagc

SEQ ID NO: 1558 - DNA, 1065 bp, Artificial Sequence
  Description of Artificial Sequence: Synthetic coding sequence
atgagcgtgaactacgccgccggcctgagcccctacgccgacaagggcaagtgcggcctgcccgagatcttcgacccccccgaggagctggagcgcaaggtgtgggagctggcccgcctggtgtggcagagcagcagcgtggtgttccacaccggcgccggcatcagcaccgccagcggcatccccgacttccgcggcccccacggcgtgtggaccatggaggagcgcggcctggcccccaagttcgacaccaccttcgagagcgcccgccccacccagacccacatggccctggtgcagctggagcgcgtgggcctgctgcgcttcctggtgagccagaacgtggacggcctgcacgtgcgcagcggcttcccccgcgacaagctggccgagctgcacggcaacatgttcgtggaggagtgcgccaagtgcaagacccagtacgtgcgcgacaccgtggtgggcaccatgggcctgaaggccaccggccgcctgtgcaccgtggccaaggcccgcggcctgcgcgcctgccgcggcgagctgcgcgacaccatcctggactgggaggacagcctgcccgaccgcgacctggccctggccgacgaggccagccgcaacgccgacctgagcatcaccctgggcaccagcctgcagatccgccccagcggcaacctgcccctggccaccaagcgccgcggcggccgcctggtgatcgtgaacctgcagcccaccaagcacgaccgccacgccgacctgcgcatccacggctacgtggacgaggtgatgacccgcctgatgaagcacctgggcctggagatccccgcctgggacggcccccgcgtgctggagcgcgccctgccccccctgccccgcccccccacccccaagctggagcccaaggaggagagccccacccgcatcaacggcagcatccccgccggccccaagcaggagccctgcgcccagcacaacggcagcgagcccgccagccccaagcgcgagcgccccaccagccccgccccccaccgcccccccaagcgcgtgaaggccaaggccgtgcccagc

SEQ ID NO: 1559 - DNA, 849 bp, Artificial Sequence
  Description of Artificial Sequence: Synthetic coding sequence
atggaggagcgcggcctggcccccaagttcgacaccaccttcgagagcgcccgccccacccagacccacatggccctggtgcagctggagcgcgtgggcctgctgcgcttcctggtgagccagaacgtggacggcctgcacgtgcgcagcggcttcccccgcgacaagctggccgagctgcacggcaacatgttcgtggaggagtgcgccaagtgcaagacccagtacgtgcgcgacaccgtggtgggcaccatgggcctgaaggccaccggccgcctgtgcaccgtggccaaggcccgcggcctgcgcgcctgccgcggcgagctgcgcgacaccatcctggactgggaggacagcctgcccgaccgcgacctggccctggccgacgaggccagccgcaacgccgacctgagcatcaccctgggcaccagcctgcagatccgccccagcggcaacctgcccctggccaccaagcgccgcggcggccgcctggtgatcgtgaacctgcagcccaccaagcacgaccgccacgccgacctgcgcatccacggctacgtggacgaggtgatgacccgcctgatgaagcacctgggcctggagatccccgcctgggacggcccccgcgtgctggagcgcgccctgccccccctgccccgcccccccacccccaagctggagcccaaggaggagagccccacccgcatcaacggcagcatccccgccggccccaagcaggagccctgcgcccagcacaacggcagcgagcccgccagccccaagcgcgagcgccccaccagccccgccccccaccgcccccccaagcgcgtgaaggccaaggccgtgcccagc

SEQ ID NO: 1560 - DNA, 1572 bp, Artificial Sequence
  Description of Artificial Sequence: Synthetic coding sequence
atgaccgaggacaaggtgaccggcaccctggtgttcaccgtgatcaccgccgtgctgggcagcttccagttcggctacgacatcggcgtgatcaacgccccccagcaggtgatcatcagccactaccgccacgtgctgggcgtgcccctggacgaccgcaaggccatcaacaactacgtgatcaacagcaccgacgagctgcccaccatcagctacagcatgaaccccaagcccaccccctgggccgaggaggagaccgtggccgccgcccagctgatcaccatgctgtggagcctgagcgtgagcagcttcgccgtgggcggcatgaccgccagcttcttcggcggctggctgggcgacaccctgggccgcatcaaggccatgctggtggccaacatcctgagcctggtgggcgccctgctgatgggcttcagcaagctgggccccagccacatcctgatcatcgccggccgcagcatcagcggcctgtactgcggcctgatcagcggcctggtgcccatgtacatcggcgagatcgcccccaccgccctgcgcggcgccctgggcaccttccaccagctggccatcgtgaccggcatcctgatcagccagatcatcggcctggagttcatcctgggcaactacgacctgtggcacatcctgctgggcctgagcggcgtgcgcgccatcctgcagagcctgctgctgttcttctgccccgagagcccccgctacctgtacatcaagctggacgaggaggtgaaggccaagcagagcctgaagcgcctgcgcggctacgacgacgtgaccaaggacatcaacgagatgcgcaaggagcgcgaggaggccagcagcgagcagaaggtgagcatcatccagctgttcaccaacagcagctaccgccagcccatcctggtggccctgatgctgcacgtggcccagcagttcagcggcatcaacggcatcttctactacagcaccagcatcttccagaccgccggcatcagcaagcccgtgtacgccaccatcggcgtgggcgccgtgaacatggtgttcaccgccgtgagcgtgttcctggtggagaaggccggccgccgcagcctgttcctgatcggcatgagcggcatgttcgtgtgcgccatcttcatgagcgtgggcctggtgctgctgaacaagttcagctggatgagctacgtgagcatgatcgccatcttcctgttcgtgagcttcttcgagatcggccccggccccatcccctggttcatggtggccgagttcttcagccagggcccccgccccgccgccctggccatcgccgccttcagcaactggacctgcaacttcatcgtggccctgtgcttccagtacatcgccgacttctgcggcccctacgtgttcttcctgttcgccggcgtgctgctggccttcaccctgttcaccttcttcaaggtgcccgagaccaagggcaagagcttcgaggagatcgccgccgagttccagaagaagagcggcagcgcccaccgccccaaggccgccgtggagatgaagttcctgggcgccaccgagaccgtg

SEQ ID NO: 1561 - DNA, 1215 bp, Artificial Sequence
  Description of Artificial Sequence: Synthetic coding sequence
atgcacctgaaccgcatcaaggccatgctggtggccaacatcctgagcctggtgggcgccctgctgatgggcttcagcaagctgggccccagccacatcctgatcatcgccggccgcagcatcagcggcctgtactgcggcctgatcagcggcctggtgcccatgtacatcggcgagatcgcccccaccgccctgcgcggcgccctgggcaccttccaccagctggccatcgtgaccggcatcctgatcagccagatcatcggcctggagttcatcctgggcaactacgacctgtggcacatcctgctgggcctgagcggcgtgcgcgccatcctgcagagcctgctgctgttcttctgccccgagagcccccgctacctgtacatcaagctggacgaggaggtgaaggccaagcagagcctgaagcgcctgcgcggctacgacgacgtgaccaaggacatcaacgagatgcgcaaggagcgcgaggaggccagcagcgagcagaaggtgagcatcatccagctgttcaccaacagcagctaccgccagcccatcctggtggccctgatgctgcacgtggcccagcagttcagcggcatcaacggcatcttctactacagcaccagcatcttccagaccgccggcatcagcaagcccgtgtacgccaccatcggcgtgggcgccgtgaacatggtgttcaccgccgtgagcgtgttcctggtggagaaggccggccgccgcagcctgttcctgatcggcatgagcggcatgttcgtgtgcgccatcttcatgagcgtgggcctggtgctgctgaacaagttcagctggatgagctacgtgagcatgatcgccatcttcctgttcgtgagcttcttcgagatcggccccggccccatcccctggttcatggtggccgagttcttcagccagggcccccgccccgccgccctggccatcgccgccttcagcaactggacctgcaacttcatcgtggccctgtgcttccagtacatcgccgacttctgcggcccctacgtgttcttcctgttcgccggcgtgctgctggccttcaccctgttcaccttcttcaaggtgcccgagaccaagggcaagagcttcgaggagatcgccgccgagttccagaagaagagcggcagcgcccaccgccccaaggccgccgtggagatgaagttcctgggcgccaccgagaccgtg

SEQ ID NO: 1562 - DNA, 2493 bp, Artificial Sequence
  Description of Artificial Sequence: Synthetic coding sequence
atggagcgcccctggggcgccgccgacggcctgagccgctggccccacggcctgggcctgctgctgctgctgcagctgctgccccccagcaccctgagccaggaccgcctggacgccccccccccccccgccgcccccctgccccgctggagcggccccatcggcgtgagctggggcctgcgcgccgccgccgccggcggcgccttcccccgcggcggccgctggcgccgcagcgcccccggcgaggacgaggagtgcggccgcgtgcgcgacttcgtggccaagctggccaacaacacccaccagcacgtgttcgacgacctgcgcggcagcgtgagcctgagctgggtgggcgacagcaccggcgtgatcctggtgctgaccaccttccacgtgcccctggtgatcatgaccttcggccagagcaagctgtaccgcagcgaggactacggcaagaacttcaaggacatcaccgacctgatcaacaacaccttcatccgcaccgagttcggcatggccatcggccccgagaacagcggcaaggtggtgctgaccgccgaggtgagcggcggcagccgcggcggccgcatcttccgcagcagcgacttcgccaagaacttcgtgcagaccgacctgcccttccaccccctgacccagatgatgtacagcccccagaacagcgactacctgctggccctgagcaccgagaacggcctgtgggtgagcaagaacttcggcggcaagtgggaggagatccacaaggccgtgtgcctggccaagtggggcagcgacaacaccatcttcttcaccacctacgccaacggcagctgcaaggccgacctgggcgccctggagctgtggcgcaccagcgacctgggcaagagcttcaagaccatcggcgtgaagatctacagcttcggcctgggcggccgcttcctgttcgccagcgtgatggccgacaaggacaccacccgccgcatccacgtgagcaccgaccagggcgacacctggagcatggcccagctgcccagcgtgggccaggagcagttctacagcatcctggccgccaacgacgacatggtgttcatgcacgtggacgagcccggcgacaccggcttcggcaccatcttcaccagcgacgaccgcggcatcgtgtacagcaagagcctggaccgccacctgtacaccaccaccggcggcgagaccgacttcaccaacgtgaccagcctgcgcggcgtgtacatcaccagcgtgctgagcgaggacaacagcatccagaccatgatcaccttcgaccagggcggccgctggacccacctgcgcaagcccgagaacagcgagtgcgacgccaccgccaagaacaagaacgagtgcagcctgcacatccacgccagctacagcatcagccagaagctgaacgtgcccatggcccccctgagcgagcccaacgccgtgggcatcgtgatcgcccacggcagcgtgggcgacgccatcagcgtgatggtgcccgacgtgtacatcagcgacgacggcggctacagctggaccaagatgctggagggcccccactactacaccatcctggacagcggcggcatcatcgtggccatcgagcacagcagccgccccatcaacgtgatcaagttcagcaccgacgagggccagtgctggcagacctacaccttcacccgcgaccccatctacttcaccggcctggccagcgagcccggcgcccgcagcatgaacatcagcatctggggcttcaccgagagcttcctgaccagccagtgggtgagctacaccatcgacttcaaggacatcctggagcgcaactgcgaggagaaggactacaccatctggctggcccacagcaccgaccccgaggactacgaggacggctgcatcctgggctacaaggagcagttcctgcgcctgcgcaagagcagcgtgtgccagaacggccgcgactacgtggtgaccaagcagcccagcatctgcctgtgcagcctggaggacttcctgtgcgacttcggctactaccgccccgagaacgacagcaagtgcgtggagcagcccgagctgaagggccacgacctggagttctgcctgtacggccgcgaggagcacctgaccaccaacggctaccgcaagatccccggcgacaagtgccagggcggcgtgaaccccgtgcgcgaggtgaaggacctgaagaagaagtgcaccagcaacttcctgagccccgagaagcagaacagcaagagcaacagcgtgcccatcatcctggccatcgtgggcctgatgctggtgaccgtggtggccggcgtgctgatcgtgaagaagtacgtgtgcggcggccgcttcctggtgcaccgctacagcgtgctgcagcagcacgccgaggccaacggcgtggacggcgtggacgccctggacaccgccagccacaccaacaagagcggctaccacgacgacagcgacgaggacctgctggag

SEQ ID NO: 1563 - DNA, 2082 bp, Artificial Sequence
  Description of Artificial Sequence: Synthetic coding sequence
atgaccttcggccagagcaagctgtaccgcagcgaggactacggcaagaacttcaaggacatcaccgacctgatcaacaacaccttcatccgcaccgagttcggcatggccatcggccccgagaacagcggcaaggtggtgctgaccgccgaggtgagcggcggcagccgcggcggccgcatcttccgcagcagcgacttcgccaagaacttcgtgcagaccgacctgcccttccaccccctgacccagatgatgtacagcccccagaacagcgactacctgctggccctgagcaccgagaacggcctgtgggtgagcaagaacttcggcggcaagtgggaggagatccacaaggccgtgtgcctggccaagtggggcagcgacaacaccatcttcttcaccacctacgccaacggcagctgcaccgacctgggcgccctggagctgtggcgcaccagcgacctgggcaagagcttcaagaccatcggcgtgaagatctacagcttcggcctgggcggccgcttcctgttcgccagcgtgatggccgacaaggacaccacccgccgcatccacgtgagcaccgaccagggcgacacctggagcatggcccagctgcccagcgtgggccaggagcagttctacagcatcctggccgccaacgacgacatggtgttcatgcacgtggacgagcccggcgacaccggcttcggcaccatcttcaccagcgacgaccgcggcatcgtgtacagcaagagcctggaccgccacctgtacaccaccaccggcggcgagaccgacttcaccaacgtgaccagcctgcgcggcgtgtacatcaccagcgtgctgagcgaggacaacagcatccagaccatgatcaccttcgaccagggcggccgctggacccacctgcgcaagcccgagaacagcgagtgcgacgccaccgccaagaacaagaacgagtgcagcctgcacatccacgccagctacagcatcagccagaagctgaacgtgcccatggcccccctgagcgagcccaacgccgtgggcatcgtgatcgcccacggcagcgtgggcgacgccatcagcgtgatggtgcccgacgtgtacatcagcgacgacggcggctacagctggaccaagatgctggagggcccccactactacaccatcctggacagcggcggcatcatcgtggccatcgagcacagcagccgccccatcaacgtgatcaagttcagcaccgacgagggccagtgctggcagacctacaccttcacccgcgaccccatctacttcaccggcctggccagcgagcccggcgcccgcagcatgaacatcagcatctggggcttcaccgagagcttcctgaccagccagtgggtgagctacaccatcgacttcaaggacatcctggagcgcaactgcgaggagaaggactacaccatctggctggcccacagcaccgaccccgaggactacgaggacggctgcatcctgggctacaaggagcagttcctgcgcctgcgcaagagcagcgtgtgccagaacggccgcgactacgtggtgaccaagcagcccagcatctgcctgtgcagcctggaggacttcctgtgcgacttcggctactaccgccccgagaacgacagcaagtgcgtggagcagcccgagctgaagggccacgacctggagttctgcctgtacggccgcgaggagcacctgaccaccaacggctaccgcaagatccccggcgacaagtgccagggcggcgtgaaccccgtgcgcgaggtgaaggacctgaagaagaagtgcaccagcaacttcctgagccccgagaagcagaacagcaagagcaacagcgtgcccatcatcctggccatcgtgggcctgatgctggtgaccgtggtggccggcgtgctgatcgtgaagaagtacgtgtgcggcggccgcttcctggtgcaccgctacagcgtgctgcagcagcacgccgaggccaacggcgtggacggcgtggacgccctggacaccgccagccacaccaacaagagcggctaccacgacgacagcgacgaggacctgctggag

SEQ ID NO: 1564 - DNA, 1761 bp, Artificial Sequence
  Description of Artificial Sequence: Synthetic coding sequence
atgccccgctacggcgccagcctgcgccagagctgcccccgcagcggccgcgagcagggccaggacggcaccgccggcgcccccggcctgctgtggatgggcctggtgctggccctggccctggccctggccctggccctggccctgagcgacagccgcgtgctgtgggcccccgccgaggcccaccccctgagcccccagggccaccccgcccgcctgcaccgcatcgtgccccgcctgcgcgacgtgttcggctggggcaacctgacctgccccatctgcaagggcctgttcaccgccatcaacctgggcctgaagaaggagcccaacgtggcccgcgtgggcagcgtggccatcaagctgtgcaacctgctgaagatcgccccccccgccgtgtgccagagcatcgtgcacctgttcgaggacgacatggtggaggtgtggcgccgcagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagccgcatcctgttcctgaccgacctgcactgggaccacgactacctggagggcaccgaccccgactgcgccgaccccctgtgctgccgccgcggcagcggcctgccccccgccagccgccccggcgccggctactggggcgagtacagcaagtgcgacctgcccctgcgcaccctggagagcctgctgagcggcctgggccccgccggccccttcgacatggtgtactggaccggcgacatccccgcccacgacgtgtggcaccagacccgccaggaccagctgcgcgccctgaccaccgtgaccgccctggtgcgcaagttcctgggccccgtgcccgtgtaccccgccgtgggcaaccacgagagcacccccgtgaacagcttccccccccccttcatcgagggcaaccacagcagccgctggctgtacgaggccatggccaaggcctgggagccctggctgcccgccgaggccctgcgcaccctgcgctacctgagcagcgtggagacccaggagggcaagcgcaaggtgcacatcatcggccacatcccccccggccactgcctgaagagctggagctggaactactaccgcatcgtggcccgctacgagaacaccctggccgcccagttcttcggccacacccacgtggacgagttcgaggtgttctacgacgaggagaccctgagccgccccctggccgtggccttcctggcccccagcgccaccacctacatcggcctgaaccccggctaccgcgtgtaccagatcgacggcaactacagcggcagcagccacgtggtgctggaccacgagacctacatcctgaacctgacccaggccaacatccccggcgccatcccccactggcagctgctgtaccgcgcccgcgagacctacggcctgcccaacaccctgcccaccgcctggcacaacctggtgtaccgcatgcgcggcgacatgcagctgttccagaccttctggttcctgtaccacaagggccacccccccagcgagccctgcggcaccccctgccgcctggccaccctgtgcgcccagctgagcgcccgcgccgacagccccgccctgtgccgccacctgatgcccgacggcagcctgcccgaggcccagagcctgtggccccgccccctgttctgc

SEQ ID NO: 1565 - DNA, 1893 bp, Artificial Sequence
  Description of Artificial Sequence: Synthetic coding sequence
atgccccgctacggcgccagcctgcgccagagctgcccccgcagcggccgcgagcagggccaggacggcaccgccggcgcccccggcctgctgtggatgggcctggtgctggccctggccctggccctggccctggccctggccctgagcgacagccgcgtgctgtgggcccccgccgaggcccaccccctgagcccccagggccaccccgcccgcctgcaccgcatcgtgccccgcctgcgcgacgtgttcggctggggcaacctgacctgccccatctgcaagggcctgttcaccgccatcaacctgggcctgaagaaggagcccaacgtggcccgcgtgggcagcgtggccatcaagctgtgcaacctgctgaagatcgccccccccgccgtgtgccagagcatcgtgcacctgttcgaggacgacatggtggaggtgtggcgccgcagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagccgcatcctgttcctgaccgacctgcactgggaccacgactacctggagggcaccgaccccgactgcgccgaccccctgtgctgccgccgcggcagcggcctgccccccgccagccgccccggcgccggctactggggcgagtacagcaagtgcgacctgcccctgcgcaccctggagagcctgctgagcggcctgggccccgccggccccttcgacatggtgtactggaccggcgacatccccgcccacgacgtgtggcaccagacccgccaggaccagctgcgcgccctgaccaccgtgaccgccctggtgcgcaagttcctgggccccgtgcccgtgtaccccgccgtgggcaaccacgagagcacccccgtgaacagcttccccccccccttcatcgagggcaaccacagcagccgctggctgtacgaggccatggccaaggcctgggagccctggctgcccgccgaggccctgcgcaccctgcgcatcggcggcttctacgccctgagcccctaccccggcctgcgcctgatcagcctgaacatgaacttctgcagccgcgagaacttctggctgctgatcaacagcaccgaccccgccggccagctgcagtggctggtgggcgagctgcaggccgccgaggaccgcggcgacaaggtgcacatcatcggccacatcccccccggccactgcctgaagagctggagctggaactactaccgcatcgtggcccgctacgagaacaccctggccgcccagttcttcggccacacccacgtggacgagttcgaggtgttctacgacgaggagaccctgagccgccccctggccgtggccttcctggcccccagcgccaccacctacatcggcctgaaccccggctaccgcgtgtaccagatcgacggcaactacagcggcagcagccacgtggtgctggaccacgagacctacatcctgaacctgacccaggccaacatccccggcgccatcccccactggcagctgctgtaccgcgcccgcgagacctacggcctgcccaacaccctgcccaccgcctggcacaacctggtgtaccgcatgcgcggcgacatgcagctgttccagaccttctggttcctgtaccacaagggccacccccccagcgagccctgcggcaccccctgccgcctggccaccctgtgcgcccagctgagcgcccgcgccgacagccccgccctgtgccgccacctgatgcccgacggcagcctgcccgaggcccagagcctgtggccccgccccctgttctgc

SEQ ID NO: 1566 - DNA, 1725 bp, Artificial Sequence
  Description of Artificial Sequence: Synthetic coding sequence
atgccccgctacggcgccagcctgcgccagagctgcccccgcagcggccgcgagcagggccaggacggcaccgccggcgcccccggcctgctgtggatgggcctggtgctggccctggccctggccctggccctggccctggccctgagcgacagccgcgtgctgtgggcccccgccgaggcccaccccctgagcccccagggccaccccgcccgcctgcaccgcatcgtgccccgcctgcgcgacgtgttcggctggggcaacctgacctgccccatctgcaagggcctgttcaccgccatcaacctgggcctgaagaaggagcccaacgtggcccgcgtgggcagcgtggccatcaagctgtgcaacctgctgaagatcgccccccccgccgtgtgccagagcatcgtgcacctgttcgaggacgacatggtggaggtgtggcgccgcagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagccgcatcctgttcctgaccgacctgcactgggaccacgactacctggagggcaccgaccccgactgcgccgaccccctgtgctgccgccgcggcagcggcctgccccccgccagccgccccggcgccggctactggggcgagtacagcaagtgcgacctgcccctgcgcaccctggagagcctgctgagcggcctgggccccgccggccccttcgacatggtgtactggaccggcgacatccccgcccacgacgtgtggcaccagacccgccaggaccagctgcgcgccctgaccaccgtgaccgccctggtgcgcaagttcctgggccccgtgcccgtgtaccccgccgtgggcaaccacgagagcacccccgtgaacagcttccccccccccttcatcgagggcaaccacagcagccgctggctgtacgaggccatggccaaggcctgggagccctggctgcccgccgaggccctgcgcaccctgcgcaaggtgcacatcatcggccacatcccccccggccactgcctgaagagctggagctggaactactaccgcatcgtggcccgctacgagaacaccctggccgcccagttcttcggccacacccacgtggacgagttcgaggtgttctacgacgaggagaccctgagccgccccctggccgtggccttcctggcccccagcgccaccacctacatcggcctgaaccccggctaccgcgtgtaccagatcgacggcaactacagcggcagcagccacgtggtgctggaccacgagacctacatcctgaacctgacccaggccaacatccccggcgccatcccccactggcagctgctgtaccgcgcccgcgagacctacggcctgcccaacaccctgcccaccgcctggcacaacctggtgtaccgcatgcgcggcgacatgcagctgttccagaccttctggttcctgtaccacaagggccacccccccagcgagccctgcggcaccccctgccgcctggccaccctgtgcgcccagctgagcgcccgcgccgacagccccgccctgtgccgccacctgatgcccgacggcagcctgcccgaggcccagagcctgtggccccgccccctgttctgc

SEQ ID NO: 1567 - DNA, 1890 bp, Artificial Sequence
  Description of Artificial Sequence: Synthetic coding sequence
atgccccgctacggcgccagcctgcgccagagctgcccccgcagcggccgcgagcagggccaggacggcaccgccggcgcccccggcctgctgtggatgggcctggtgctggccctggccctggccctggccctggccctggccctgagcgacagccgcgtgctgtgggcccccgccgaggcccaccccctgagcccccagggccaccccgcccgcctgcaccgcatcgtgccccgcctgcgcgacgtgttcggctggggcaacctgacctgccccatctgcaagggcctgttcaccgccatcaacctgggcctgaaggagcccaacgtggcccgcgtgggcagcgtggccatcaagctgtgcaacctgctgaagatcgccccccccgccgtgtgccagagcatcgtgcacctgttcgaggacgacatggtggaggtgtggcgccgcagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagccgcatcctgttcctgaccgacctgcactgggaccacgactacctggagggcaccgaccccgactgcgccgaccccctgtgctgccgccgcggcagcggcctgccccccgccagccgccccggcgccggctactggggcgagtacagcaagtgcgacctgcccctgcgcaccctggagagcctgctgagcggcctgggccccgccggccccttcgacatggtgtactggaccggcgacatccccgcccacgacgtgtggcaccagacccgccaggaccagctgcgcgccctgaccaccgtgaccgccctggtgcgcaagttcctgggccccgtgcccgtgtaccccgccgtgggcaaccacgagagcacccccgtgaacagcttccccccccccttcatcgagggcaaccacagcagccgctggctgtacgaggccatggccaaggcctgggagccctggctgcccgccgaggccctgcgcaccctgcgcatcggcggcttctacgccctgagcccctaccccggcctgcgcctgatcagcctgaacatgaacttctgcagccgcgagaacttctggctgctgatcaacagcaccgaccccgccggccagctgcagtggctggtgggcgagctgcaggccgccgaggaccgcggcgacaaggtgcacatcatcggccacatcccccccggccactgcctgaagagctggagctggaactactaccgcatcgtggcccgctacgagaacaccctggccgcccagttcttcggccacacccacgtggacgagttcgaggtgttctacgacgaggagaccctgagccgccccctggccgtggccttcctggcccccagcgccaccacctacatcggcctgaaccccggctaccgcgtgtaccagatcgacggcaactacagcggcagcagccacgtggtgctggaccacgagacctacatcctgaacctgacccaggccaacatccccggcgccatcccccactggcagctgctgtaccgcgcccgcgagacctacggcctgcccaacaccctgcccaccgcctggcacaacctggtgtaccgcatgcgcggcgacatgcagctgttccagaccttctggttcctgtaccacaagggccacccccccagcgagccctgcggcaccccctgccgcctggccaccctgtgcgcccagctgagcgcccgcgccgacagccccgccctgtgccgccacctgatgcccgacggcagcctgcccgaggcccagagcctgtggccccgccccctgttctgc

SEQ ID NO: 1568 - DNA, 1098 bp, Artificial Sequence
  Description of Artificial Sequence: Synthetic coding sequence
atgccccgctacggcgccagcctgcgccagagctgcccccgcagcggccgcgagcagggccaggacggcaccgccggcgcccccggcctgctgtggatgggcctggtgctggccctggccctggccctggccctggccctggccctgagcgacagccgcgtgctgtgggcccccgccgaggcccaccccctgagcccccagggccaccccgcccgcctgcaccgcatcgtgccccgcctgcgcgacgtgttcggctggggcaacctgacctgccccatctgcaagggcctgttcaccgccatcaacctgggcctgaagaaggagcccaacgtggcccgcgtgggcagcgtggccatcaagctgtgcaacctgctgaagatcgccccccccgccgtgtgccagagcatcgtgcacctgttcgaggacgacatggtggaggtgtggcgccgcagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagccgcatcctgttcctgaccgacctgcactgggaccacgactacctggagggcaccgaccccgactgcgccgaccccctgtgctgccgccgcggcagcggcctgccccccgccagccgccccggcgccggctactggggcgagtacagcaagtgcgacctgcccctgcgcaccctggagagcctgctgagcggcctgggccccgccggccccttcgacatggtgtactggaccggcgacatccccgcccacgacgtgtggcaccagacccgccaggaccagctgcgcgccctgaccaccgtgaccgccctggtgcgcaagttcctgggccccgtgcccgtgtaccccgccgtgggcaaccacgagagcacccccgtgaacagcttccccccccccttcatcgagggcaaccacagcagccgctggctgtacgaggccatggccaaggcctgggagccctggctgcccgccgaggccctgcgcaccctgcgctgcatc

SEQ ID NO: 1569 - DNA, 1206 bp, Artificial Sequence
  Description of Artificial Sequence: Synthetic coding sequence
atgccccgctacggcgccagcctgcgccagagctgcccccgcagcggccgcgagcagggccaggacggcaccgccggcgcccccggcctgctgtggatgggcctggtgctggccctggccctggccctggccctggccctggccctgagcgacagccgcgtgctgtgggcccccgccgaggcccaccccctgagcccccagggccaccccgcccgcctgcaccgcatcgtgccccgcctgcgcgacgtgttcggctggggcaacctgacctgccccatctgcaagggcctgttcaccgccatcaacctgggcctgaagaaggagcccaacgtggcccgcgtgggcagcgtggccatcaagctgtgcaacctgctgaagatcgccccccccgccgtgtgccagagcatcgtgcacctgttcgaggacgacatggtggaggtgtggcgccgcagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagccgcatcctgttcctgaccgacctgcactgggaccacgactacctggagggcaccgaccccgactgcgccgaccccctgtgctgccgccgcggcagcggcctgccccccgccagccgccccggcgccggctactggggcgagtacagcaagtgcgacctgcccctgcgcaccctggagagcctgctgagcggcctgggccccgccggccccttcgacatggtgtactggaccggcgacatccccgcccacgacgtgtggcaccagacccgccaggaccagctgcgcgccctgaccaccgtgaccgccctggtgcgcaagttcctgggccccgtgcccgtgtaccccgccgtgggcaaccacgagagcacccccgtgaacagcttccccccccccttcatcgagggcaaccacagcagccgctggctgtacgaggccatggccaaggcctgggagccctggctgcccgccgaggccctgcgcaccctgcgctacctgagcagcgtggagacccaggagggcaagcgcaagaactggggcgtgctgtgcagcttccccatcccccgcagccccccccacctgagccagtacgagttcctgttcccc

SEQ ID NO: 1570 - DNA, 1725 bp, Artificial Sequence
  Description of Artificial Sequence: Synthetic coding sequence
atgctgggcgtgctggtgctgggcgccctggccctggccggcctgggcttccccgcccccgccgagccccagcccggcggcagccagtgcgtggagcacgactgcttcgccctgtaccccggccccgccaccttcctgaacgccagccagatctgcgacggcctgcgcggccacctgatgaccgtgcgcagcagcgtggccgccgacgtgatcagcctgctgctgaacggcgacggcggcgtgggccgccgccgcctgtggatcggcctgcagctgccccccggctgcggcgaccccaagcgcctgggccccctgcgcggcttccagtgggtgaccggcgacaacaacaccagctacagccgctgggcccgcctggacctgaacggcgcccccctgtgcggccccctgtgcgtggccgtgagcgccgccgaggccaccgtgcccagcgagcccatctgggaggagcagcagtgcgaggtgaaggccgacggcttcctgtgcgagttccacttccccgccacctgccgccccctggccgtggagcccggcgccgccgccgccgccgtgagcatcacctacggcacccccttcgccgcccgcggcgccgacttccaggccctgcccgtgggcagcagcgccgccgtggcccccctgggcctgcagctgatgtgcaccgccccccccggcgccgtgcagggccactgggcccgcgaggcccccggcgcctgggactgcagcgtggagaacggcggctgcgagcacgcctgcaacgccatccccggcgccccccgctgccagtgccccgccggcgccgccctgcaggccgacggccgcagctgcaccgccagcgccacccagagctgcaacgacctgtgcgagcacttctgcgtgcccaaccccgaccagcccggcagctacagctgcatgtgcgagaccggctaccgcctggccgccgaccagcaccgctgcgaggacgtggacgactgcatcctggagcccagcccctgcccccagcgctgcgtgaacacccagggcggcttcgagtgccactgctaccccaactacgacctggtggacggcgagtgcgtggagcccgtggacccctgcttccgcgccaactgcgagtaccagtgccagcccctgaaccagaccagctacctgtgcgtgtgcgccgagggcttcgcccccatcccccacgagccccaccgctgccagatgttctgcaaccagaccgcctgccccgccgactgcgaccccaacacccaggccagctgcgagtgccccgagggctacatcctggacgacggcttcatctgcaccgacatcgacgagtgcgagaacggcggcttctgcagcggcgtgtgccacaacctgcccggcaccttcgagtgcatctgcggccccgacagcgccctggcccgccacatcggcaccgactgcgacagcggcaaggtggacggcggcgacagcggcagcggcgagcccccccccagccccacccccggcagcaccctgaccccccccgccgtgggcctggtgcacagcggcctgctgatcggcatcagcatcgccagcctgtgcctggtggtggccctgctggccctgctgtgccacctgcgcaagaagcagggcgccgcccgcgccaagatggagtacaagtgcgccgcccccagcaaggaggtggtgctgcagcacgtgcgcaccgagcgcaccccccagcgcctg

SEQ ID NO: 1571 - DNA, 1059 bp, Artificial Sequence
  Description of Artificial Sequence: Synthetic coding sequence
atggagctgaccgagctgctgctggtggtgatgctgctgctgaccgcccgcctgaccctgagcagccccgccccccccgcctgcgacctgcgcgtgctgagcaagctgctgcgcgacagccacgtgctgcacagccgcctgagccagtgccccgaggtgcaccccctgcccacccccgtgctgctgcccgccgtggacttcagcctgggcgagtggaagacccagatggaggagaccaaggcccaggacatcctgggcgccgtgaccctgctgctggagggcgtgatggccgcccgcggccagctgggccccacctgcctgagcagcctgctgggccagctgagcggccaggtgcgcctgctgctgggcgccctgcagagcctgctgggcacccagctgcccccccagggccgcaccaccgcccacaaggaccccaacgccatcttcctgagcttccagcacctgctgcgcggcaaggtgcgcttcctgatgctggtgggcggcagcaccctgtgcgtgcgccgcgccccccccaccaccgccgtgcccagccgcaccagcctggtgctgaccctgaacgagctgcccaaccgcaccagcggcctgctggagaccaacttcaccgccagcgcccgcaccaccggcagcggcctgctgaagtggcagcagggcttccgcgccaagatccccggcctgctgaaccagaccagccgcagcctggaccagatccccggctacctgaaccgcatccacgagctgctgaacggcacccgcggcctgttccccggccccagccgccgcaccctgggcgcccccgacatcagcagcggcaccagcgacaccggcagcctgccccccaacctgcagcccggctacagccccagccccacccacccccccaccggccagtacaccctgttccccctgccccccaccctgcccacccccgtggtgcagctgcaccccctgctgcccgaccccagcgcccccacccccacccccaccagccccctgctgaacaccagctacacccacagccagaacctgagccaggagggc

SEQ ID NO: 1572 - DNA, 858 bp, Artificial Sequence
  Description of Artificial Sequence: Synthetic coding sequence
atggagctgaccgagctgctgctggtggtgatgctgctgctgaccgcccgcctgaccctgagcagccccgccccccccgcctgcgacctgcgcgtgctgagcaagctgctgcgcgacagccacgtgctgcacagccgcctgagccagtgccccgaggtgcaccccctgcccacccccgtgctgctgcccgccgtggacttcagcctgggcgagtggaagacccagatggaggagaccaaggcccaggacatcctgggcgccgtgaccctgctgctggagggcgtgatggccgcccgcggccagctgggccccacctgcctgagcagcctgctgggccagctgagcggccaggtgcgcctgctgctgggcgccctgcagagcctgctgggcacccagctgcccccccagggccgcaccaccgcccacaaggaccccaacgccatcttcctgagcttccagcacctgctgcgcggcaaggacttctggatcgtgggcgacaagctgcactgcctgagccagaactactggctgtgggccagcgaggtggccgccggcatccagagccaggacagctggagcgccgagcccaacctgcaggtgcccggccccaacccccgcatccccgagcaggacacccgcaccctggagtggaacagctggaccctgagctggaccctgacccaggacccccgcagccccggccacttcctgcgcaacatccgccaccgcctgcccgccacccagccccccgcctggatcttcagcttccccaaccccagcagctactggaccgtgtacgccctgcccagcagcacccacctggcccacccctgcggccccgcccccccccccgccagc

SEQ ID NO: 1573 - DNA, 1047 bp, Artificial Sequence
  Description of Artificial Sequence: Synthetic coding sequence
atggagctgaccgagctgctgctggtggtgatgctgctgctgaccgcccgcctgaccctgagcagccccgccccccccgcctgcgacctgcgcgtgctgagcaagctgctgcgcgacagccacgtgctgcacagccgcctgagccagtgccccgaggtgcaccccctgcccacccccgtgctgctgcccgccgtggacttcagcctgggcgagtggaagacccagatggaggagaccaaggcccaggacatcctgggcgccgtgaccctgctgctggagggcgtgatggccgcccgcggccagctgggccccacctgcctgagcagcctgctgggccagctgagcggccaggtgcgcctgctgctgggcgccctgcagagcctgctgggcacccagggccgcaccaccgcccacaaggaccccaacgccatcttcctgagcttccagcacctgctgcgcggcaaggtgcgcttcctgatgctggtgggcggcagcaccctgtgcgtgcgccgcgccccccccaccaccgccgtgcccagccgcaccagcctggtgctgaccctgaacgagctgcccaaccgcaccagcggcctgctggagaccaacttcaccgccagcgcccgcaccaccggcagcggcctgctgaagtggcagcagggcttccgcgccaagatccccggcctgctgaaccagaccagccgcagcctggaccagatccccggctacctgaaccgcatccacgagctgctgaacggcacccgcggcctgttccccggccccagccgccgcaccctgggcgcccccgacatcagcagcggcaccagcgacaccggcagcctgccccccaacctgcagcccggctacagccccagccccacccacccccccaccggccagtacaccctgttccccctgccccccaccctgcccacccccgtggtgcagctgcaccccctgctgcccgaccccagcgcccccacccccacccccaccagccccctgctgaacaccagctacacccacagccagaacctgagccaggagggc

SEQ ID NO: 1574 - DNA, 1179 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggccccccgcatgcccgaggccgccccccccgtggcccccgcccccgccgcccccacccccgccgcccccgcccccgcccccagctggcccctgagcagcagcgtgcccagccagaagacctaccagggcagctacggcttccgcctgggcttcctgcacagcggcaccgccaagagcgtgacctgcacctacagccccgccctgaacaagatgttctgccagctggccaagacctgccccgtgcagctgtgggtggacagcacccccccccccggcacccgcgtgcgcgccatggccatctacaagcagagccagcacatgaccgaggtggtgcgccgctgcccccaccacgagcgctgcagcgacagcgacggcctggcccccccccagcacctgatccgcgtggagggcaacctgcgcgtggagtacctggacgaccgcaacaccttccgccacagcgtggtggtgccctacgagccccccgaggtgggcagcgactgcaccaccatccactacaactacatgtgcaacagcagctgcatgggcggcatgaaccgccgccccatcctgaccatcatcaccctggaggacagcagcggcaacctgctgggccgcaacagcttcgaggtgcgcgtgtgcgcctgccccggccgcgaccgccgcaccgaggaggagaacctgcgcaagaagggcgagccccaccacgagctgccccccggcagcaccaagcgcgccctgcccaacaacaccagcagcagcccccagcccaagaagaagcccctggacggcgagtacttcaccctgcagatccgcggccgcgagcgcttcgagatgttccgcgagctgaacgaggccctggagctgaaggacgcccaggccggcaaggagcccggcggcagccgcgcccacagcagccacctgaagagcaagaagggccagagcaccagccgccacaagaagctgatgttcaagaccgagggccccgacagcgac

SEQ ID NO: 1575 - DNA, 1029 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggccccccgcatgcccgaggccgccccccccgtggcccccgcccccgccgcccccacccccgccgcccccgcccccgcccccagctggcccctgagcagcagcgtgcccagccagaagacctaccagggcagctacggcttccgcctgggcttcctgcacagcggcaccgccaagagcgtgacctgcacctacagccccgccctgaacaagatgttctgccagctggccaagacctgccccgtgcagctgtgggtggacagcacccccccccccggcacccgcgtgcgcgccatggccatctacaagcagagccagcacatgaccgaggtggtgcgccgctgcccccaccacgagcgctgcagcgacagcgacggcctggcccccccccagcacctgatccgcgtggagggcaacctgcgcgtggagtacctggacgaccgcaacaccttccgccacagcgtggtggtgccctacgagccccccgaggtgggcagcgactgcaccaccatccactacaactacatgtgcaacagcagctgcatgggcggcatgaaccgccgccccatcctgaccatcatcaccctggaggacagcagcggcaacctgctgggccgcaacagcttcgaggtgcgcgtgtgcgcctgccccggccgcgaccgccgcaccgaggaggagaacctgcgcaagaagggcgagccccaccacgagctgccccccggcagcaccaagcgcgccctgcccaacaacaccagcagcagcccccagcccaagaagaagcccctggacggcgagtacttcaccctgcagaagaccttccccgcccgccacggcggcagccacctg

SEQ ID NO: 1576 - DNA, 855 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggccccccgcatgcccgaggccgccccccccgtggcccccgcccccgccgcccccacccccgccgcccccgcccccgcccccagctggcccctgagcagcagcgtgcccagccagaagacctaccagggcagctacggcttccgcctgggcttcctgcacagcggcaccgccaagagcgtgacctgcacctacagccccgccctgaacaagatgttctgccagctggccaagacctgccccgtgcagctgtgggtggacagcacccccccccccggcacccgcgtgcgcgccatggccatctacaagcagagccagcacatgaccgaggtggtgcgccgctgcccccaccacgagcgctgcagcgacagcgacggcctggcccccccccagcacctgatccgcgtggagggcaacctgcgcgtggagtacctggacgaccgcaacaccttccgccacagcgtggtggtgccctacgagccccccgaggtgggcagcgactgcaccaccatccactacaactacatgtgcaacagcagctgcatgggcggcatgaaccgccgccccatcctgaccatcatcaccctggaggacagccgcccccgccaggtggaccacctgcgcagcggcgtgcaggacagcctggccaacatcgccaagagccacctgtac

SEQ ID NO: 1577 - DNA, 1023 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggccccccgcatgcccgaggccgccccccccgtggcccccgcccccgccgcccccacccccgccgcccccgcccccgcccccagctggcccctgagcagcagcgtgcccagccagaagacctaccagggcagctacggcttccgcctgggcttcctgcacagcggcaccgccaagagcgtgacctgcacctacagccccgccctgaacaagatgttctgccagctggccaagacctgccccgtgcagctgtgggtggacagcacccccccccccggcacccgcgtgcgcgccatggccatctacaagcagagccagcacatgaccgaggtggtgcgccgctgcccccaccacgagcgctgcagcgacagcgacggcctggcccccccccagcacctgatccgcgtggagggcaacctgcgcgtggagtacctggacgaccgcaacaccttccgccacagcgtggtggtgccctacgagccccccgaggtgggcagcgactgcaccaccatccactacaactacatgtgcaacagcagctgcatgggcggcatgaaccgccgccccatcctgaccatcatcaccctggaggacagcagcggcaacctgctgggccgcaacagcttcgaggtgcgcgtgtgcgcctgccccggccgcgaccgccgcaccgaggaggagaacctgcgcaagaagggcgagccccaccacgagctgccccccggcagcaccaagcgcgccctgcccaacaacaccagcagcagcccccagcccaagaagaagcccctggacggcgagtacttcaccctgcaggaccagaccagcttccagaaggagaactgc

SEQ ID NO: 1578 - DNA, 1038 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggccccccgcatgcccgaggccgccccccccgtggcccccgcccccgccgcccccacccccgccgcccccgcccccgcccccagctggcccctgagcagcagcgtgcccagccagaagacctaccagggcagctacggcttccgcctgggcttcctgcacagcggcaccgccaagagcgtgacctgcacctacagccccgccctgaacaagatgttctgccagctggccaagacctgccccgtgcagctgtgggtggacagcacccccccccccggcacccgcgtgcgcgccatggccatctacaagcagagccagcacatgaccgaggtggtgcgccgctgcccccaccacgagcgctgcagcgacagcgacggcctggcccccccccagcacctgatccgcgtggagggcaacctgcgcgtggagtacctggacgaccgcaacaccttccgccacagcgtggtggtgccctacgagccccccgaggtgggcagcgactgcaccaccatccactacaactacatgtgcaacagcagctgcatgggcggcatgaaccgccgccccatcctgaccatcatcaccctggaggacagcagcggcaacctgctgggccgcaacagcttcgaggtgcgcgtgtgcgcctgccccggccgcgaccgccgcaccgaggaggagaacctgcgcaagaagggcgagccccaccacgagctgccccccggcagcaccaagcgcgccctgcccaacaacaccagcagcagcccccagcccaagaagaagcccctggacggcgagtacttcaccctgcagatgctgctggacctgcgctggtgctacttcctgatcaacagcagc

SEQ ID NO: 1579 - DNA, 384 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggccccccgcatgcccgaggccgccccccccgtggcccccgcccccgccgcccccacccccgccgcccccgcccccgcccccagctggcccctgagcagcagcgtgcccagccagaagacctaccagggcagctacggcttccgcctgggcttcctgcacagcggcaccgccaagagcgtgacctgcacctacagcccc

SEQ ID NO: 1580 - DNA, 495 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggccccccgcatgcccgaggccgccccccccgtggcccccgcccccgccgcccccacccccgccgcccccgcccccgcccccagctggcccctgagcagcagcgtgcccagccagaagacctaccagggcagctacggcttccgcctgggcttcctgcacagcggcaccgccaagagcgtgacctgcacctacagccccgccctgaacaagatgttctgccagctggccaagacctgccccgtgcagctgtgggtggacagcacccccccccccggcacccgcgtgcgcgccatggccatctacaagcag

SEQ ID NO: 1581 - DNA, 597 bp, Artificial Sequence
  Description of Artificial Sequence: Synthetic coding sequence
atgttctgccagctggccaagacctgccccgtgcagctgtgggtggacagcacccccccccccggcacccgcgtgcgcgccatggccatctacaagcagagccagcacatgaccgaggtggtgcgccgctgcccccaccacgagcgctgcagcgacagcgacggcctggcccccccccagcacctgatccgcgtggagggcaacctgcgcgtggagtacctggacgaccgcaacaccttccgccacagcgtggtggtgccctacgagccccccgaggtgggcagcgactgcaccaccatccactacaactacatgtgcaacagcagctgcatgggcggcatgaaccgccgccccatcctgaccatcatcaccctggaggacagcagcggcaacctgctgggccgcaacagcttcgaggtgcgcgtgtgcgcctgccccggccgcgaccgccgcaccgaggaggagaacctgcgcaagaagggcgagccccaccacgagctgccccccggcagcaccaagcgcgccctgcccaacaacaccagcagcagcccccagcccaagaagaagcccctggacggcgagtacttcaccctgcag

SEQ ID NO: 1582 - DNA, 465 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgtacagccccgccctgaacaagatgttctgccagctggccaagacctgccccgtgcagctgtgggtggacagcacccccccccccggcacccgcgtgcgcgccatggccatctacaagcagagccagcacatgaccgaggtggtgcgccgctgcccccaccacgagcgctgcagcgacagcgacggcctggcccccccccagcacctgatccgcgtggagggcaacctgcgcgtggagtacctggacgaccgcaacaccttccgccacagcgtggtggtgccctacgagccccccgaggtgggcagcgactgcaccaccatccactacaactacatgtgcaacagcagctgcatgggcggcatgaaccgc

SEQ ID NO: 1583 - DNA, 1362 bp, Artificial Sequence
  Description of Artificial Sequence: Synthetic coding sequence
atggacccctacatgatccagatgagcagcaagggcaacctgcccagcatcctggacgtgcacgtgaacgtgggcggccgcagcagcgtgcccggcaagatgaagggccgcaaggcccgctggagcgtgcgccccagcgacatggccaagaagaccttcaaccccatccgcgccatcgtggacaacatgaaggtgaagcccaaccccaacaagaccatgatcagcctgagcatcggcgaccccaccgtgttcggcaacctgcccaccgaccccgaggtgacccaggccatgaaggacgccctggacagcggcaagtacaacggctacgcccccagcatcggcttcctgagcagccgcgaggagatcgccagctactaccactgccccgaggcccccctggaggccaaggacgtgatcctgaccagcggctgcagccaggccatcgacctgtgcctggccgtgctggccaaccccggccagaacatcctggtgccccgccccggcttcagcctgtacaagaccctggccgagagcatgggcatcgaggtgaagctgtacaacctgctgcccgagaagagctgggagatcgacctgaagcagctggagtacctgatcgacgagaagaccgcctgcctgatcgtgaacaaccccagcaacccctgcggcagcgtgttcagcaagcgccacctgcagaagatcctggccgtggccgcccgccagtgcgtgcccatcctggccgacgagatctacggcgacatggtgttcagcgactgcaagtacgagcccctggccaccctgagcaccgacgtgcccatcctgagctgcggcggcctggccaagcgctggctggtgcccggctggcgcctgggctggatcctgatccacgaccgccgcgacatcttcggcaacgagatccgcgacggcctggtgaagctgagccagcgcatcctgggcccctgcaccatcgtgcagggcgccctgaagagcatcctgtgccgcacccccggcgagttctaccacaacaccctgagcttcctgaagagcaacgccgacctgtgctacggcgccctggccgccatccccggcctgcgccccgtgcgccccagcggcgccatgtacctgatggtgggcatcgagatggagcacttccccgagttcgagaacgacgtggagttcaccgagcgcctggtggccgagcagagcgtgcactgcctgcccgccacctgcttcgagtaccccaacttcatccgcgtggtgatcaccgtgcccgaggtgatgatgctggaggcctgcagccgcatccaggagttctgcgagcagcactaccactgcgccgagggcagccaggaggagtgcgacaag

SEQ ID NO: 1584 - DNA, 1599 bp, Artificial Sequence
  Description of Artificial Sequence: Synthetic coding sequence
atggccgtggagagccagggcggccgccccctggtgctgggcctgctgctgtgcgtgctgggccccgtggtgagccacgccggcaagatcctgctgatccccgtggacggcagccactggctgagcatgctgggcgccatccagcagctgcagcagcgcggccacgagatcgtggtgctggcccccgacgccagcctgtacatccgcgacggcgccttctacaccctgaagacctaccccgtgcccttccagcgcgaggacgtgaaggagagcttcgtgagcctgggccacaacgtgttcgagaacgacagcttcctgcagcgcgtgatcaagacctacaagaagatcaagaaggacagcgccatgctgctgagcggctgcagccacctgctgcacaacaaggagctgatggccagcctggccgagagcagcttcgacgtgatgctgaccgaccccttcctgccctgcagccccatcgtggcccagtacctgagcctgcccaccgtgttcttcctgcacgccctgccctgcagcctggagttcgaggccacccagtgccccaaccccttcagctacgtgccccgccccctgagcagccacagcgaccacatgaccttcctgcagcgcgtgaagaacatgctgatcgccttcagccagaacttcctgtgcgacgtggtgtacagcccctacgccaccctggccagcgagttcctgcagcgcgaggtgaccgtgcaggacctgctgagcagcgccagcgtgtggctgttccgcagcgacttcgtgaaggactacccccgccccatcatgcccaacatggtgttcgtgggcggcatcaactgcctgcaccagaaccccctgagccaggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggcgctacaccggcacccgccccagcaacctggccaacaacaccatcctggtgaagtggctgccccagaacgacctgctgggccaccccatgacccgcgccttcatcacccacgccggcagccacggcgtgtacgagagcatctgcaacggcgtgcccatggtgatgatgcccctgttcggcgaccagatggacaacgccaagcgcatggagaccaagggcgccggcgtgaccctgaacgtgctggagatgaccagcgaggacctggagaacgccctgaaggccgtgatcaacgacaagagctacaaggagaacatcatgcgcctgagcagcctgcacaaggaccgccccgtggagcccctggacctggccgtgttctgggtggagttcgtgatgcgccacaagggcgccccccacctgcgccccgccgcccacgacctgacctggtaccagtaccacagcctggacgtgatcggcttcctgctggccgtggtgctgaccgtggccttcatcaccttcaagtgctgcgcctacggctaccgcaagtgcctgggcaagaagggccgcgtgaagaaggcccacaagagcaagacccac

SEQ ID NO: 1585 - DNA, 1332 bp, Artificial Sequence
  Description of Artificial Sequence: Synthetic coding sequence
atggccgtggagagccagggcggccgccccctggtgctgggcctgctgctgtgcgtgctgggccccgtggtgagccacgccggcaagatcctgctgatccccgtggacggcagccactggctgagcatgctgggcgccatccagcagctgcagcagcgcggccacgagatcgtggtgctggcccccgacgccagcctgtacatccgcgacggcgccttctacaccctgaagacctaccccgtgcccttccagcgcgaggacgtgaaggagagcttcgtgagcctgggccacaacgtgttcgagaacgacagcttcctgcagcgcgtgatcaagacctacaagaagatcaagaaggacagcgccatgctgctgagcggctgcagccacctgctgcacaacaaggagctgatggccagcctggccgagagcagcttcgacgtgatgctgaccgaccccttcctgccctgcagccccatcgtggcccagtacctgagcctgcccaccgtgttcttcctgcacgccctgccctgcagcctggagttcgaggccacccagtgccccaaccccttcagctacgtgccccgccccctgagcagccacagcgaccacatgaccttcctgcagcgcgtgaagaacatgctgatcgccttcagccagaacttcctgtgcgacgtggtgtacagcccctacgccaccctggccagcgagttcctgcagcgcgaggtgaccgtgcaggacctgctgagcagcgccagcgtgtggctgttccgcagcgacttcgtgaaggactacccccgccccatcatgcccaacatggtgttcgtgggcggcatcaactgcctgcaccagaaccccctgagccaggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggcgctacaccggcacccgccccagcaacctggccaacaacaccatcctggtgaagtggctgccccagaacgacctgctgggccaccccatgacccgcgccttcatcacccacgccggcagccacggcgtgtacgagagcatctgcaacggcgtgcccatggtgatgatgcccctgttcggcgaccagatggacaacgccaagcgcatggagaccaagggcgccggcgtgaccctgaacgtgctggagatgaccagcgaggacctggagaacgccctgaaggccgtgatcaacgacaagcgcaagaagcagcagagcggccgccagatg

SEQ ID NO: 1586 - DNA, 489 bp, Artificial Sequence
  Description of Artificial Sequence: Synthetic coding sequence
atggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaacccctgcggcccctgcagcgagcgccgcaagcacctgttcgtgcaggacccccagacctgcaagtgcagctgcaagaacaccgacagccgctgcaaggcccgccagctggagctgaacgagcgcacctgccgctgcgacaagccccgccgc

SEQ ID NO: 1587 - DNA, 951 bp, Artificial Sequence
  Description of Artificial Sequence: Synthetic coding sequence
ctgaccgaccgccagaccgacaccgcccccagccccagctaccacctgctgcccggccgccgccgcaccgtggacgccgccgccagccgcggccagggccccgagcccgcccccggcggcggcgtggagggcgtgggcgcccgcggcgtggccctgaagctgttcgtgcagctgctgggctgcagccgcttcggcggcgccgtggtgcgcgccggcgaggccgagcccagcggcgccgcccgcagcgccagcagcggccgcgaggagccccagcccgaggagggcgaggaggaggaggagaaggaggaggagcgcggcccccagtggcgcctgggcgcccgcaagcccggcagctggaccggcgaggccgccgtgtgcgccgacagcgcccccgccgcccgcgccccccaggccctggcccgcgccagcggccgcggcggccgcgtggcccgccgcggcgccgaggagagcggccccccccacagccccagccgccgcggcagcgccagccgcgccggccccggccgcgccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgctgcgacaagccccgccgc

SEQ ID NO: 1588 - DNA, 1236 bp, Artificial Sequence
  Description of Artificial Sequence: Synthetic coding sequence
ctgaccgaccgccagaccgacaccgcccccagccccagctaccacctgctgcccggccgccgccgcaccgtggacgccgccgccagccgcggccagggccccgagcccgcccccggcggcggcgtggagggcgtgggcgcccgcggcgtggccctgaagctgttcgtgcagctgctgggctgcagccgcttcggcggcgccgtggtgcgcgccggcgaggccgagcccagcggcgccgcccgcagcgccagcagcggccgcgaggagccccagcccgaggagggcgaggaggaggaggagaaggaggaggagcgcggcccccagtggcgcctgggcgcccgcaagcccggcagctggaccggcgaggccgccgtgtgcgccgacagcgcccccgccgcccgcgccccccaggccctggcccgcgccagcggccgcggcggccgcgtggcccgccgcggcgccgaggagagcggccccccccacagccccagccgccgcggcagcgccagccgcgccggccccggccgcgccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaagaagagcgtgcgcggcaagggcaagggccagaagcgcaagcgcaagaagagccgctacaagagctggagcgtgtacgtgggcgcccgctgctgcctgatgccctggagcctgcccggcccccacccctgcggcccctgcagcgagcgccgcaagcacctgttcgtgcaggacccccagacctgcaagtgcagctgcaagaacaccgacagccgctgcaaggcccgccagctggagctgaacgagcgcacctgccgctgcgacaagccccgccgc

SEQ ID NO: 1589 - DNA, 981 bp, Artificial Sequence
  Description of Artificial Sequence: Synthetic coding sequence
ctgaccgaccgccagaccgacaccgcccccagccccagctaccacctgctgcccggccgccgccgcaccgtggacgccgccgccagccgcggccagggccccgagcccgcccccggcggcggcgtggagggcgtgggcgcccgcggcgtggccctgaagctgttcgtgcagctgctgggctgcagccgcttcggcggcgccgtggtgcgcgccggcgaggccgagcccagcggcgccgcccgcagcgccagcagcggccgcgaggagccccagcccgaggagggcgaggaggaggaggagaaggaggaggagcgcggcccccagtggcgcctgggcgcccgcaagcccggcagctggaccggcgaggccgccgtgtgcgccgacagcgcccccgccgcccgcgccccccaggccctggcccgcgccagcggccgcggcggccgcgtggcccgccgcggcgccgaggagagcggccccccccacagccccagccgccgcggcagcgccagccgcgccggccccggccgcgccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaagtgcgacaagccccgccgc

SEQ ID NO: 1590 - DNA, 1113 bp, Artificial Sequence
  Description of Artificial Sequence: Synthetic coding sequence
ctgaccgaccgccagaccgacaccgcccccagccccagctaccacctgctgcccggccgccgccgcaccgtggacgccgccgccagccgcggccagggccccgagcccgcccccggcggcggcgtggagggcgtgggcgcccgcggcgtggccctgaagctgttcgtgcagctgctgggctgcagccgcttcggcggcgccgtggtgcgcgccggcgaggccgagcccagcggcgccgcccgcagcgccagcagcggccgcgaggagccccagcccgaggagggcgaggaggaggaggagaaggaggaggagcgcggcccccagtggcgcctgggcgcccgcaagcccggcagctggaccggcgaggccgccgtgtgcgccgacagcgcccccgccgcccgcgccccccaggccctggcccgcgccagcggccgcggcggccgcgtggcccgccgcggcgccgaggagagcggccccccccacagccccagccgccgcggcagcgccagccgcgccggccccggccgcgccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaacccctgcggcccctgcagcgagcgccgcaagcacctgttcgtgcaggacccccagacctgcaagtgcagctgcaagaacaccgacagccgctgcaaggcccgccagctggagctgaacgagcgcacctgccgctgcgacaagccccgccgc

SEQ ID NO: 1591 - DNA, 441 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaagtgcgacaagccccgccgc

SEQ ID NO: 1592 - DNA, 1167 bp, Artificial Sequence
  Description of Artificial Sequence: Synthetic coding sequence
ctgaccgaccgccagaccgacaccgcccccagccccagctaccacctgctgcccggccgccgccgcaccgtggacgccgccgccagccgcggccagggccccgagcccgcccccggcggcggcgtggagggcgtgggcgcccgcggcgtggccctgaagctgttcgtgcagctgctgggctgcagccgcttcggcggcgccgtggtgcgcgccggcgaggccgagcccagcggcgccgcccgcagcgccagcagcggccgcgaggagccccagcccgaggagggcgaggaggaggaggagaaggaggaggagcgcggcccccagtggcgcctgggcgcccgcaagcccggcagctggaccggcgaggccgccgtgtgcgccgacagcgcccccgccgcccgcgccccccaggccctggcccgcgccagcggccgcggcggccgcgtggcccgccgcggcgccgaggagagcggccccccccacagccccagccgccgcggcagcgccagccgcgccggccccggccgcgccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaagaagagcgtgcgcggcaagggcaagggccagaagcgcaagcgcaagaagagccgcccctgcggcccctgcagcgagcgccgcaagcacctgttcgtgcaggacccccagacctgcaagtgcagctgcaagaacaccgacagccgctgcaaggcccgccagctggagctgaacgagcgcacctgccgctgcgacaagccccgccgc

SEQ ID NO: 1593 - DNA, 1062 bp, Artificial Sequence
  Description of Artificial Sequence: Synthetic coding sequence
ctgaccgaccgccagaccgacaccgcccccagccccagctaccacctgctgcccggccgccgccgcaccgtggacgccgccgccagccgcggccagggccccgagcccgcccccggcggcggcgtggagggcgtgggcgcccgcggcgtggccctgaagctgttcgtgcagctgctgggctgcagccgcttcggcggcgccgtggtgcgcgccggcgaggccgagcccagcggcgccgcccgcagcgccagcagcggccgcgaggagccccagcccgaggagggcgaggaggaggaggagaaggaggaggagcgcggcccccagtggcgcctgggcgcccgcaagcccggcagctggaccggcgaggccgccgtgtgcgccgacagcgcccccgccgcccgcgccccccaggccctggcccgcgccagcggccgcggcggccgcgtggcccgccgcggcgccgaggagagcggccccccccacagccccagccgccgcggcagcgccagccgcgccggccccggccgcgccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaacccctgcggcccctgcagcgagcgccgcaagcacctgttcgtgcaggacccccagacctgcaagtgcagctgcaagaacaccgacagccgctgcaagatg

SEQ ID NO: 1594 - DNA, 1185 bp, Artificial Sequence
  Description of Artificial Sequence: Synthetic coding sequence
ctgaccgaccgccagaccgacaccgcccccagccccagctaccacctgctgcccggccgccgccgcaccgtggacgccgccgccagccgcggccagggccccgagcccgcccccggcggcggcgtggagggcgtgggcgcccgcggcgtggccctgaagctgttcgtgcagctgctgggctgcagccgcttcggcggcgccgtggtgcgcgccggcgaggccgagcccagcggcgccgcccgcagcgccagcagcggccgcgaggagccccagcccgaggagggcgaggaggaggaggagaaggaggaggagcgcggcccccagtggcgcctgggcgcccgcaagcccggcagctggaccggcgaggccgccgtgtgcgccgacagcgcccccgccgcccgcgccccccaggccctggcccgcgccagcggccgcggcggccgcgtggcccgccgcggcgccgaggagagcggccccccccacagccccagccgccgcggcagcgccagccgcgccggccccggccgcgccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaagaagagcgtgcgcggcaagggcaagggccagaagcgcaagcgcaagaagagccgctacaagagctggagcgtgccctgcggcccctgcagcgagcgccgcaagcacctgttcgtgcaggacccccagacctgcaagtgcagctgcaagaacaccgacagccgctgcaaggcccgccagctggagctgaacgagcgcacctgccgctgcgacaagccccgccgc

SEQ ID NO: 1595 - DNA, 411 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgctgcgacaagccccgccgc

SEQ ID NO: 1596 - DNA, 1113 bp, Artificial Sequence
  Description of Artificial Sequence: Synthetic coding sequence
ctgaccgaccgccagaccgacaccgcccccagccccagctaccacctgctgcccggccgccgccgcaccgtggacgccgccgccagccgcggccagggccccgagcccgcccccggcggcggcgtggagggcgtgggcgcccgcggcgtggccctgaagctgttcgtgcagctgctgggctgcagccgcttcggcggcgccgtggtgcgcgccggcgaggccgagcccagcggcgccgcccgcagcgccagcagcggccgcgaggagccccagcccgaggagggcgaggaggaggaggagaaggaggaggagcgcggcccccagtggcgcctgggcgcccgcaagcccggcagctggaccggcgaggccgccgtgtgcgccgacagcgcccccgccgcccgcgccccccaggccctggcccgcgccagcggccgcggcggccgcgtggcccgccgcggcgccgaggagagcggccccccccacagccccagccgccgcggcagcgccagccgcgccggccccggccgcgccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaacccctgcggcccctgcagcgagcgccgcaagcacctgttcgtgcaggacccccagacctgcaagtgcagctgcaagaacaccgacagccgctgcaaggcccgccagctggagctgaacgagcgcacctgccgcagcctgacccgcaaggac

SEQ ID NO: 1597 - DNA, 627 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaagaagagcgtgcgcggcaagggcaagggccagaagcgcaagcgcaagaagagccgcccctgcggcccctgcagcgagcgccgcaagcacctgttcgtgcaggacccccagacctgcaagtgcagctgcaagaacaccgacagccgctgcaaggcccgccagctggagctgaacgagcgcacctgccgctgcgacaagccccgccgc

SEQ ID NO: 1598 - DNA, 573 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaacccctgcggcccctgcagcgagcgccgcaagcacctgttcgtgcaggacccccagacctgcaagtgcagctgcaagaacaccgacagccgctgcaaggcccgccagctggagctgaacgagcgcacctgccgcagcctgacccgcaaggac

SEQ ID NO: 1599 - DNA, 966 bp, Artificial Sequence
  Description of Artificial Sequence: Synthetic coding sequence
cgcggccagggccccgagcccgcccccggcggcggcgtggagggcgtgggcgcccgcggcgtggccctgaagctgttcgtgcagctgctgggctgcagccgcttcggcggcgccgtggtgcgcgccggcgaggccgagcccagcggcgccgcccgcagcgccagcagcggccgcgaggagccccagcccgaggagggcgaggaggaggaggagaaggaggaggagcgcggcccccagtggcgcctgggcgcccgcaagcccggcagctggaccggcgaggccgccgtgtgcgccgacagcgcccccgccgcccgcgccccccaggccctggcccgcgccagcggccgcggcggccgcgtggcccgccgcggcgccgaggagagcggccccccccacagccccagccgccgcggcagcgccagccgcgccggccccggccgcgccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaagaagagcgtgcgcggcaagggcaagggccagaagcgcaagcgcaagaagagccgctacaagagctggagcgtgtgcgacaagccccgccgc

SEQ ID NO: 1600 - DNA, 645 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaagaagagcgtgcgcggcaagggcaagggccagaagcgcaagcgcaagaagagccgctacaagagctggagcgtgccctgcggcccctgcagcgagcgccgcaagcacctgttcgtgcaggacccccagacctgcaagtgcagctgcaagaacaccgacagccgctgcaaggcccgccagctggagctgaacgagcgcacctgccgctgcgacaagccccgccgc

SEQ ID NO: 1601 - DNA, 522 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaacccctgcggcccctgcagcgagcgccgcaagcacctgttcgtgcaggacccccagacctgcaagtgcagctgcaagaacaccgacagccgctgcaagatg

SEQ ID NO: 1602 - DNA, 696 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaagaagagcgtgcgcggcaagggcaagggccagaagcgcaagcgcaagaagagccgctacaagagctggagcgtgtacgtgggcgcccgctgctgcctgatgccctggagcctgcccggcccccacccctgcggcccctgcagcgagcgccgcaagcacctgttcgtgcaggacccccagacctgcaagtgcagctgcaagaacaccgacagccgctgcaaggcccgccagctggagctgaacgagcgcacctgccgctgcgacaagccccgccgc

SEQ ID NO: 1603 - DNA, 573 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagcgcagctactgccaccccatcgagaccctggtggacatcttccaggagtaccccgacgagatcgagtacatcttcaagcccagctgcgtgcccctgatgcgctgcggcggctgctgcaacgacgagggcctggagtgcgtgcccaccgaggagagcaacatcaccatgcagatcatgcgcatcaagccccaccagggccagcacatcggcgagatgagcttcctgcagcacaacaagtgcgagtgccgccccaagaaggaccgcgcccgccaggagaacccctgcggcccctgcagcgagcgccgcaagcacctgttcgtgcaggacccccagacctgcaagtgcagctgcaagaacaccgacagccgctgcaaggcccgccagctggagctgaacgagcgcacctgccgctgcgacaagccccgccgc

SEQ ID NO: 1604 - DNA, 1260 bp, Artificial Sequence
  Description of Artificial Sequence: Synthetic coding sequence
atgcacctgctgggcttcttcagcgtggcctgcagcctgctggccgccgccctgctgcccggcccccgcgaggcccccgccgccgccgccgccttcgagagcggcctggacctgagcgacgccgagcccgacgccggcgaggccaccgcctacgccagcaaggacctggaggagcagctgcgcagcgtgagcagcgtggacgagctgatgaccgtgctgtaccccgagtactggaagatgtacaagtgccagctgcgcaagggcggctggcagcacaaccgcgagcaggccaacctgaacagccgcaccgaggagaccatcaagttcgccgccgcccactacaacaccgagatcctgaagagcatcgacaacgagtggcgcaagacccagtgcatgccccgcgaggtgtgcatcgacgtgggcaaggagttcggcgtggccaccaacaccttcttcaagcccccctgcgtgagcgtgtaccgctgcggcggctgctgcaacagcgagggcctgcagtgcatgaacaccagcaccagctacctgagcaagaccctgttcgagatcaccgtgcccctgagccagggccccaagcccgtgaccatcagcttcgccaaccacaccagctgccgctgcatgagcaagctggacgtgtaccgccaggtgcacagcatcatccgccgcagcctgcccgccaccctgccccagtgccaggccgccaacaagacctgccccaccaactacatgtggaacaaccacatctgccgctgcctggcccaggaggacttcatgttcagcagcgacgccggcgacgacagcaccgacggcttccacgacatctgcggccccaacaaggagctggacgaggagacctgccagtgcgtgtgccgcgccggcctgcgccccgccagctgcggcccccacaaggagctggaccgcaacagctgccagtgcgtgtgcaagaacaagctgttccccagccagtgcggcgccaaccgcgagttcgacgagaacacctgccagtgcgtgtgcaagcgcacctgcccccgcaaccagcccctgaaccccggcaagtgcgcctgcgagtgcaccgagagcccccagaagtgcctgctgaagggcaagaagttccaccaccagacctgcagctgctaccgccgcccctgcaccaaccgccagaaggcctgcgagcccggcttcagctacagcgaggaggtgtgccgctgcgtgcccagctactggaagcgcccccagatgatgagc

SEQ ID NO: 1605 - DNA, 507 bp, Artificial Sequence
  Description of Artificial Sequence: Synthetic coding sequence
atggacacccgcaacaaggcccagctgctggtgctgctgaccctgctgagcgtgctgttcagccagaccagcgcctggcccctgtaccgcgcccccagcgccctgcgcctgggcgaccgcatccccttcgagggcgccaacgagcccgaccaggtgagcctgaaggaggacatcgacatgctgcagaacgccctggccgagaacgacaccccctactacgacgtgagccgcaacgcccgccacgccgacggcgtgttcaccagcgacttcagcaagctgctgggccagctgagcgccaagaagtacctggagagcctgatgggcaagcgcgtgagcaacatcagcgaggaccccgtgcccgtgaagcgccacagcgacgccgtgttcaccgacaactacacccgcctgcgcaagcagatggccgtgaagaagtacctgaacagcatcctgaacggcaagcgcagcagcgagggcgagagccccgacttccccgaggagctggagaag

SEQ ID NO: 1606 - DNA, 510 bp, Artificial Sequence
  Description of Artificial Sequence: Synthetic coding sequence
atggacacccgcaacaaggcccagctgctggtgctgctgaccctgctgagcgtgctgttcagccagaccagcgcctggcccctgtaccgcgcccccagcgccctgcgcctgggcgaccgcatccccttcgagggcgccaacgagcccgaccaggtgagcctgaaggaggacatcgacatgctgcagaacgccctggccgagaacgacaccccctactacgacgtgagccgcaacgcccgccacgccgacggcgtgttcaccagcgacttcagcaagctgctgggccagctgagcgccaagaagtacctggagagcctgatgggcaagcgcgtgagcagcaacatcagcgaggaccccgtgcccgtgaagcgccacagcgacgccgtgttcaccgacaactacacccgcctgcgcaagcagatggccgtgaagaagtacctgaacagcatcctgaacggcaagcgcagcagcgagggcgagagccccgacttccccgaggagctggagaag

SEQ ID NO: 1607 - DNA, 354 bp, Artificial Sequence
  Description of Artificial Sequence: Synthetic coding sequence
gtgagcctgaaggaggacatcgacatgctgcagaacgccctggccgagaacgacaccccctactacgacgtgagccgcaacgcccgccacgccgacggcgtgttcaccagcgacttcagcaagctgctgggccagctgagcgccaagaagtacctggagagcctgatgggcaagcgcgtgagcagcaacatcagcgaggaccccgtgcccgtgaagcgccacagcgacgccgtgttcaccgacaactacacccgcctgcgcaagcagatggccgtgaagaagtacctgaacagcatcctgaacggcaagcgcagcgagggcgagagccccgacttccccgaggagctggagaag

SEQ ID NO: 1608 - DNA, 8439 bp, Artificial Sequence
  Description of Artificial Sequence: Synthetic coding sequence
atgatccccgcccgcttcgccggcgtgctgctggccctggccctgatcctgcccggcaccctgtgcgccgagggcacccgcggccgcagcagcaccgcccgctgcagcctgttcggcagcgacttcgtgaacaccttcgacggcagcatgtacagcttcgccggctactgcagctacctgctggccggcggctgccagaagcgcagcttcagcatcatcggcgacttccagaacggcaagcgcgtgagcctgagcgtgtacctgggcgagttcttcgacatccacctgttcgtgaacggcaccgtgacccagggcgaccagcgcgtgagcatgccctacgccagcaagggcctgtacctggagaccgaggccggctactacaagctgagcggcgaggcctacggcttcgtggcccgcatcgacggcagcggcaacttccaggtgctgctgagcgaccgctacttcaacaagacctgcggcctgtgcggcaacttcaacatcttcgccgaggacgacttcatgacccaggagggcaccctgaccagcgacccctacgacttcgccaacagctgggccctgagcagcggcgagcagtggtgcgagcgcgccagcccccccagcagcagctgcaacatcagcagcggcgagatgcagaagggcctgtgggagcagtgccagctgctgaagagcaccagcgtgttcgcccgctgccaccccctggtggaccccgagcccttcgtggccctgtgcgagaagaccctgtgcgagtgcgccggcggcctggagtgcgcctgccccgccctgctggagtacgcccgcacctgcgcccaggagggcatggtgctgtacggctggaccgaccacagcgcctgcagccccgtgtgccccgccggcatggagtaccgccagtgcgtgagcccctgcgcccgcacctgccagagcctgcacatcaacgagatgtgccaggagcgctgcgtggacggctgcagctgccccgagggccagctgctggacgagggcctgtgcgtggagagcaccgagtgcccctgcgtgcacagcggcaagcgctacccccccggcaccagcctgagccgcgactgcaacacctgcatctgccgcaacagccagtggatctgcagcaacgaggagtgccccggcgagtgcctggtgaccggccagagccacttcaagagcttcgacaaccgctacttcaccttcagcggcatctgccagtacctgctggcccgcgactgccaggaccacagcttcagcatcgtgatcgagaccgtgcagtgcgccgacgaccgcgacgccgtgtgcacccgcagcgtgaccgtgcgcctgcccggcctgcacaacagcctggtgaagctgaagcacggcgccggcgtggccatggacggccaggacgtgcagctgcccctgctgaagggcgacctgcgcatccagcacaccgtgaccgccagcgtgcgcctgagctacggcgaggacctgcagatggactgggacggccgcggccgcctgctggtgaagctgagccccgtgtacgccggcaagacctgcggcctgtgcggcaactacaacggcaaccagggcgacgacttcctgacccccagcggcctggccgagccccgcgtggaggacttcggcaacgcctggaagctgcacggcgactgccaggacctgcagaagcagcacagcgacccctgcgccctgaacccccgcatgacccgcttcagcgaggaggcctgcgccgtgctgaccagccccaccttcgaggcctgccaccgcgccgtgagccccctgccctacctgcgcaactgccgctacgacgtgtgcagctgcagcgacggccgcgagtgcctgtgcggcgccctggccagctacgccgccgcctgcgccggccgcggcgtgcgcgtggcctggcgcgagcccggccgctgcgagctgaactgccccaagggccaggtgtacctgcagtgcggcaccccctgcaacctgacctgccgcagcctgagctaccccgacgaggagtgcaacgaggcctgcctggagggctgcttctgcccccccggcctgtacatggacgagcgcggcgactgcgtgcccaaggcccagtgcccctgctactacgacggcgagatcttccagcccgaggacatcttcagcgaccaccacaccatgtgctactgcgaggacggcttcatgcactgcaccatgagcggcgtgcccggcagcctgctgcccgacgccgtgctgagcagccccctgagccaccgcagcaagcgcagcctgagctgccgcccccccatggtgaagctggtgtgccccgccgacaacctgcgcgccgagggcctggagtgcaccaagacctgccagaactacgacctggagtgcatgagcatgggctgcgtgagcggctgcctgtgcccccccggcatggtgcgccacgagaaccgctgcgtggccctggagcgctgcccctgcttccaccagggcaaggagtacgcccccggcgagaccgtgaagatcggctgcaacacctgcgtgtgccaggaccgcaagtggaactgcaccgaccacgtgtgcgacgccacctgcagcaccatcggcatggcccactacctgaccttcgacggcctgaagtacctgttccccggcgagtgccagtacgtgctggtgcaggactactgcggcagcaaccccggcaccttccgcatcctggtgggcaacaagggctgcagccaccccagcgtgaagtgcaagaagcgcgtgaccatcctggtggagggcggcgagatcgagctgttcgacggcgaggtgaacgtgaagcgccccatgaaggacgagacccacttcgaggtggtggagagcggccgctacatcatcctgctgctgggcaaggccctgagcgtggtgtgggaccgccacctgagcatcagcgtggtgctgaagcagacctaccaggagaaggtgtgcggcctgtgcggcaacttcgacggcatccagaacaacgacctgaccagcagcaacctgcaggtggaggaggaccccgtggacttcggcaacagctggaaggtgagcagccagtgcgccgacacccgcaaggtgcccctggacagcagccccgccacctgccacaacaacatcatgaagcagaccatggtggacagcagctgccgcatcctgaccagcgacgtgttccaggactgcaacaagctggtggaccccgagccctacctggacgtgtgcatctacgacacctgcagctgcgagagcatcggcgactgcgcctgcttctgcgacaccatcgccgcctacgcccacgtgtgcgcccagcacggcaaggtggtgacctggcgcaccgccaccctgtgcccccagagctgcgaggagcgcaacctgcgcgagaacggctacgagtgcgagtggcgctacaacagctgcgcccccgcctgccaggtgacctgccagcaccccgagcccctggcctgccccgtgcagtgcgtggagggctgccacgcccactgcccccccggcaagatcctggacgagctgctgcagacctgcgtggaccccgaggactgccccgtgtgcgaggtggccggccgccgcttcgccagcggcaagaaggtgaccctgaaccccagcgaccccgagcactgccagatctgccactgcgacgtggtgaacctgacctgcgaggcctgccaggagcccggcggcctggtggtgccccccaccgacgcccccgtgagccccaccaccctgtacgtggaggacatcagcgagccccccctgcacgacttctactgcagccgcctgctggacctggtgttcctgctggacggcagcagccgcctgagcgaggccgagttcgaggtgctgaaggccttcgtggtggacatgatggagcgcctgcgcatcagccagaagtgggtgcgcgtggccgtggtggagtaccacgacggcagccacgcctacatcggcctgaaggaccgcaagcgccccagcgagctgcgccgcatcgccagccaggtgaagtacgccggcagccaggtggccagcaccagcgaggtgctgaagtacaccctgttccagatcttcagcaagatcgaccgccccgaggccagccgcatcaccctgctgctgatggccagccaggagccccagcgcatgagccgcaacttcgtgcgctacgtgcagggcctgaagaagaagaaggtgatcgtgatccccgtgggcatcggcccccacgccaacctgaagcagatccgcctgatcgagaagcaggcccccgagaacaaggccttcgtgctgagcagcgtggacgagctggagcagcagcgcgacgagatcgtgagctacctgtgcgacctggcccccgaggcccccccccccaccctgccccccgacatggcccaggtgaccgtgggccccggcctgctgggcgtgagcaccctgggccccaagcgcaacagcatggtgctggacgtggccttcgtgctggagggcagcgacaagatcggcgaggccgacttcaaccgcagcaaggagttcatggaggaggtgatccagcgcatggacgtgggccaggacagcatccacgtgaccgtgctgcagtacagctacatggtgaccgtggagtaccccttcagcgaggcccagagcaagggcgacatcctgcagcgcgtgcgcgagatccgctaccagggcggcaaccgcaccaacaccggcctggccctgcgctacctgagcgaccacagcttcctggtgagccagggcgaccgcgagcaggcccccaacctggtgtacatggtgaccggcaaccccgccagcgacgagatcaagcgcctgcccggcgacatccaggtggtgcccatcggcgtgggccccaacgccaacgtgcaggagctggagcgcatcggctggcccaacgcccccatcctgatccaggacttcgagaccctgccccgcgaggcccccgacctggtgctgcagcgctgctgcagcggcgagggcctgcagatccccaccctgagccccgcccccgactgcagccagcccctggacgtgatcctgctgctggacggcagcagcagcttccccgccagctacttcgacgagatgaagagcttcgccaaggccttcatcagcaaggccaacatcggcccccgcctgacccaggtgagcgtgctgcagtacggcagcatcaccaccatcgacgtgccctggaacgtggtgcccgagaaggcccacctgctgagcctggtggacgtgatgcagcgcgagggcggccccagccagatcggcgacgccctgggcttcgccgtgcgctacctgaccagcgagatgcacggcgcccgccccggcgccagcaaggccgtggtgatcctggtgaccgacgtgagcgtggacagcgtggacgccgccgccgacgccgcccgcagcaaccgcgtgaccgtgttccccatcggcatcggcgaccgctacgacgccgcccagctgcgcatcctggccggccccgccggcgacagcaacgtggtgaagctgcagcgcatcgaggacctgcccaccatggtgaccctgggcaacagcttcctgcacaagctgtgcagcggcttcgtgcgcatctgcatggacgaggacggcaacgagaagcgccccggcgacgtgtggaccctgcccgaccagtgccacaccgtgacctgccagcccgacggccagaccctgctgaagagccaccgcgtgaactgcgaccgcggcctgcgccccagctgccccaacagccagagccccgtgaaggtggaggagacctgcggctgccgctggacctgcccctgcgtgtgcaccggcagcagcacccgccacatcgtgaccttcgacggccagaacttcaagctgaccggcagctgcagctacgtgctgttccagaacaaggagcaggacctggaggtgatcctgcacaacggcgcctgcagccccggcgcccgccagggctgcatgaagagcatcgaggtgaagcacagcgccctgagcgtggagctgcacagcgacatggaggtgaccgtgaacggccgcctggtgagcgtgccctacgtgggcggcaacatggaggtgaacgtgtacggcgccatcatgcacgaggtgcgcttcaaccacctgggccacatcttcaccttcaccccccagaacaacgagttccagctgcagctgagccccaagaccttcgccagcaagacctacggcctgtgcggcatctgcgacgagaacggcgccaacgacttcatgctgcgcgacggcaccgtgaccaccgactggaagaccctggtgcaggagtggaccgtgcagcgccccggccagacctgccagcccatcctggaggagcagtgcctggtgcccgacagcagccactgccaggtgctgctgctgcccctgttcgccgagtgccacaaggtgctggcccccgccaccttctacgccatctgccagcaggacagctgccaccaggagcaggtgtgcgaggtgatcgccagctacgcccacctgtgccgcaccaacggcgtgtgcgtggactggcgcacccccgacttctgcgccatgagctgcccccccagcctggtgtacaaccactgcgagcacggctgcccccgccactgcgacggcaacgtgagcagctgcggcgaccaccccagcgagggctgcttctgcccccccgacaaggtgatgctggagggcagctgcgtgcccgaggaggcctgcacccagtgcatcggcgaggacggcgtgcagcaccagttcctggaggcctgggtgcccgaccaccagccctgccagatctgcacctgcctgagcggccgcaaggtgaactgcaccacccagccctgccccaccgccaaggcccccacctgcggcctgtgcgaggtggcccgcctgcgccagaacgccgaccagtgctgccccgagtacgagtgcgtgtgcgaccccgtgagctgcgacctgccccccgtgccccactgcgagcgcggcctgcagcccaccctgaccaaccccggcgagtgccgccccaacttcacctgcgcctgccgcaaggaggagtgcaagcgcgtgagcccccccagctgccccccccaccgcctgcccaccctgcgcaagacccagtgctgcgacgagtacgagtgcgcctgcaactgcgtgaacagcaccgtgagctgccccctgggctacctggccagcaccgccaccaacgactgcggctgcaccaccaccacctgcctgcccgacaaggtgtgcgtgcaccgcagcaccatctaccccgtgggccagttctgggaggagggctgcgacgtgtgcacctgcaccgacatggaggacgccgtgatgggcctgcgcgtggcccagtgcagccagaagccctgcgaggacagctgccgcagcggcttcacctacgtgctgcacgagggcgagtgctgcggccgctgcctgcccagcgcctgcgaggtggtgaccggcagcccccgcggcgacagccagagcagctggaagagcgtgggcagccagtgggccagccccgagaacccctgcctgatcaacgagtgcgtgcgcgtgaaggaggaggtgttcatccagcagcgcaacgtgagctgcccccagctggaggtgcccgtgtgccccagcggcttccagctgagctgcaagaccagcgcctgctgccccagctgccgctgcgagcgcatggaggcctgcatgctgaacggcaccgtgatcggccccggcaagaccgtgatgatcgacgtgtgcaccacctgccgctgcatggtgcaggtgggcgtgatcagcggcttcaagctggagtgccgcaagaccacctgcaacccctgccccctgggctacaaggaggagaacaacaccggcgagtgctgcggccgctgcctgcccaccgcctgcaccatccagctgcgcggcggccagatcatgaccctgaagcgcgacgagaccctgcaggacggctgcgacacccacttctgcaaggtgaacgagcgcggcgagtacttctgggagaagcgcgtgaccggctgcccccccttcgacgagcacaagtgcctggccgagggcggcaagatcatgaagatccccggcacctgctgcgacacctgcgaggagcccgagtgcaacgacatcaccgcccgcctgcagtacgtgaaggtgggcagctgcaagagcgaggtggaggtggacatccactactgccagggcaagtgcgccagcaaggccatgtacagcatcgacatcaacgacgtgcaggaccagtgcagctgctgcagccccacccgcaccgagcccatgcaggtggccctgcactgcaccaacggcagcgtggtgtaccacgaggtgctgaacgccatggagtgcaagtgcagcccccgcaagtgcagcaag

SEQ ID NO: 1609 - RNA, 581 nt, Artificial Sequence
  Description of Artificial Sequence: Synthetic coding sequence
gggaaauaagagagaaaagaagaguaagaagaaauauaagagccaccaugucgaccgagggugggggaaggcgcugucaggcgcagguaucaagacgaaucagcuucagcgcgucgcaccggcuuuacucaaaguucuugucggaugaagagaaccucaagcuguuugggaagugcaacaauccuaauggacauggacacaauuacaaagucguggucacggugcacggcgaaaucgaccccgccacggguauggucaugaauuuggccgacuugaagaaguacauggaagaggcuauuaugcaaccccuggaccauaagaaccucgauauggaugucccguauuuugcggauguagucuccacuacagagaacguggcaguauacauuugggacaaccuucagaaagugcucccagugggggugcuguauaaaguaaaagucuaugagacagacaauaacaucgugguguacaaaggagaaugauaagcugccuucugcggggcuugccuucuggccaugcccuucuucucucccuugcaccuguaccucuuggucuuugaauaaagccugaguaggaag

SEQ ID NO: 1610 - RNA, 4427 nt, Artificial Sequence
  Description of Artificial Sequence: Synthetic coding sequence
gggaaauaagagagaaaagaagaguaagaagaaauauaagagccaccaugcaccaacgacauccacgagcacgaugcccuccccugugcguagcgggaaucuuggcaugcggguuucuucucgguugcuggggaccaagccacuuccagcaauccugccuccaagcgcuugagccccaggcggugucguccuaccugucgccuggggcaccccucaaggguagacccccuucccccgguuuccagaggcaacgacagagacagcggcgggccgcggguggcaucuugcaucuggaacugcuggucgcuguaggaccggacguauuccaggcgcaucaggaggacacagagcgauauguccugacuaacuugaacaucggugcagaauuguugagggacccuucguugggggcgcaguuucggguacaucuuguaaagaugguaauccugacagaaccggaaggagcgcccaauaucacggcaaaucugacaucgagcuuguugucggucugcgguuggagccaaaccaucaaccccgaggacgacacagaucccggccacgcggaccugguccucuauaucacacgauucgaccuugagcugcccgaugguaaccgacagguccgaggagucacacaguuggguggagcaugcuccccuacuuggucaugcuugaucacggaggacaccggguuugaccuuggggugacgaucgcacaugagauuggccauucguucggauuggaacacgacggggcccccggaagcgggugcggaccgucgggacacgugauggcgagcgauggggccgccccgcgagcaggacucgccuggagcccguguagccgccgacagcuccucucccuucuuucggcgggacgcgcgaggugcgugugggaucccccucgaccgcagcccgggagcgcgggucauccgccagacgcacagcccggucuuuacuauagcgcaaacgagcagugcagggucgccuucggaccuaaagccguagcguguacauucgcgcgagaacaucucgacaugugccaggcacucagcugccauaccgacccgcuggaccagucauccuguucaaggcuuuuggucccccuccuggauggcacagagugugggguggaaaagugguguucaaaaggucgguguagaucacuugucgaauugacgccaauugccgccguccacgggagguggucaucauggggcccucgcagcccgugcucgcgaucguguggagggggcgucgugacucggaggagacagugcaacaaccccagaccggccuucggcgguagagccugcgucggggcggaccuucaagcggagauguguaacacgcaggccugugaaaagacucaguuggaguuuaugagccaacagugugccagaaccgaugggcaaccccugcggucaucgccaggaggggcgucauuuuaccacuggggagccgcagugccucacucacaaggggacgcgcugugccggcauaugugcagggccauuggggaaucauucaucaugaaacggggugacucauuccuugacggaacacgauguaugccuagcgggccuagagaggacggaacccuuuccuugugugugucgggaucauguagaacauuugggugcgauggucggauggacagccaacaggugugggacagaugccaagugugcgggggugacaacucgacgugcucgccacgaaaaggcucguucaccgccggucgagcccgggaguaugugacauuccucacgguaacgcccaaucugacgagcgucuacaucgccaaccacagaccccucuuuacccaccuugcugugcggaucggagggcgcuacgucguagcggggaagaugucgaucucgccaaauacuacauacccgucgcuucucgaagaugggcgcgucgaguacaggguggcguugaccgaggaccggcucccgcgcuuggaagagauuaggauuuggggaccucuucaagaggaugcggauauccaaguauacaggcgcuacggagaggaguacggaaaccucacaagaccggauauuacguuuacguauuuucagccgaagccucgacaggcgugggucugggcagcugugcgcgguccuuguucagucucauguggugcgggguugaggugggucaacuacucgugccucgaccaggcgcgaaaggaacucguggaaacaguacagugucaggggucccagcagccgccagcauggccugaagcguguguguuggaaccuuguccgcccuauugggcggugggagacuucgggcccuguucggcuucgugcggugguggacugagagaacgcccggugagaugcgucgaggcccagggcucacuucuuaagacucuuccuccagcaagauguagagcgggagcgcagcagcccgccguggcacuugaaacuugcaacccgcaaccaugcccagcuaggugggaggugucggaaccgucgucgugcacgucagccggaggugcaggguuggcgcuugagaaugagacuugcguaccgggagccgacgggcuugaggcaccugucacugagggaccggguucggucgacgaaaaacuccccgccccugagccuugcguaggcaugucgugcccgccaggauggggacaccuggacgcgaccagcgcaggcgaaaaagcuccgucgccgugggguuccauucgcaccggagcucaagcagcacacgucuggaccccggcagcggggucaugcuccguaucgugcggcagagggcugauggaacucagauucuuguguauggauucggcgcugcgggugccugugcaagaagagcuuugugggcucgccucaaagccugguagcagacgcgaagugugucaagcggugccgugcccagcaagauggcaguacaaacuggcagccugcucgguaucgugugguagaggagucguccggcgaauucucuauugcgcacgggcgcacggagaggacgauggggaggagauccuuuuggauacucagugccagggauugcccaggcccgaaccccaagaagcguguucgcucgaacccuguccgccacgguggaaaguaaugucgcucgggccgugcucagcgucguguggguugggaacugcacggcggagcguggcguguguccaguuggaucaagggcaggauguggagguggacgaggcagcgugugcggcacuuguacggcccgaagcgucggugccgugcuugaucgcagauugcacauaccgcuggcaugucggcacguggauggaguguuccgugucaugcggggacggaauccagcggcgacgcgauacgugucuugggccgcaggcgcaggcaccggucccggcugacuucugccagcaccucccgaagccugucacggugcgcgggugcugggcgggacccugcguggggcagggaacucccucacucgugccgcaugaggaagcagcugcuccgggacggacuacugcgaccccggcaggggcaucauuggaauggucacaggccagaggguuguuguucucgccugcaccacaaccgcgcagacuccucccuggaccacaagagaacagcguccagucaagcgcauguggacgacagcaccuugaaccgacuggaacgaucgacaugagggguccggggcaggcagacugcgccguggccaucgguagaccguugggugaggugguaacgcuuaggguccucgaaucaucgcuuaauugcucagccggugacaugcuccuguugugggggaggcugaccuggcggaagaugugucgcaagcuccucgauaugacguuuucguccaaaacgaauacacuuguggugagacagagauguggucgaccggguggcggugugcugcucagauauggcucgcaguuggcacccgaaacauucuaccgagaaugugacaugcaacuguuugggccauggggagagauugucagcccgucgcucucaccggcaacuucgaacgccggaggcugucgacucuucaucaauguggccccucaugcccgcauugcaauccacgcucucgcgacgaacaugggggcaggaacugaaggggcgaaugcguccuauaucuugaucagggauacacacucauugcgaacaacggcguuucauggucagcaaguacuguauugggaaucggaguccucgcaagcggagauggaguuuucggaaggcuuucuuaaagcccaggccucgcuuaggggccaguauuggacccuucagagcugggucccugaaaugcaagacccccagucguggaaagggaaagagggaacgugauaagcugccuucugcggggcuugccuucuggccaugcccuucuucucucccuugcaccuguaccucuuggucuuugaauaaagccugaguaggaag

SEQ ID NO: 1611 - RNA, 4427 nt, Artificial Sequence; identical to SEQ ID NO: 1610
  Description of Artificial Sequence: Synthetic coding sequence

SEQ ID NO: 1612 - RNA, 1487 nt, Artificial Sequence
  Description of Artificial Sequence: Synthetic coding sequence
gggaaauaagagagaaaagaagaguaagaagaaauauaagagccaccauguccgcgucaaaaaucccacucuuuaagaugaaagaucucauccucauucucugccuuuuggagauguccuuugcagugccuuucuucccccagcaguccggcaccccugguauggccagccuuucgcuggaaacaaugaggcagcucggcagccuucagcgacugaacacauugucgcaguauucccgcuacgguuucgggaagucguucaauagcuuguggaugcauggguugcuucccccacacucgucacugcccuggaugaggccaagagaacacgagacacagcaauaugaguacucgcuuccagugcauccucccccucuucccagccagccuucgcucaagccacagcagccuggguugaagccuuucuugcaguccgcagccgcgacaacgaaucaggccacugcucugaaagaagccuugcagccgccuauucaccuugggcaucucccgcuccaagaaggcgagcugccacuuguacagcagcaggucgccccuucggacaagcccccaaaaccggaacuccccggugucgauuuugcugacccucaagggcccucauugccuggaauggacuuucccgauccccaaggcccgucgcuuccggguuuggauuucgcagacccgcaaggaucgacaaucuuucaaauugcgcggcuuaucucgcacgggccuaugccgcagaauaagcagucaccccuguaccccggaaugcuuuauguccccuuuggggccaaucagcucaaugccccugcccgauugggcaucaugucgucagaagagguagcaggugggcgcgaggauccgauggcguacggggccauguuccccggauucggugguaugagacccggguucgaggggaugccucacaacccggcgauggguggcgauuuuaccuuggaguuugauucgcccguggcggcgacuaaaggaccggagaacgaagaggguggugcgcagggauccccgaugccggaagccaauccggauaaccucgagaauccggcuuuccugacggagcucgagccagcgccgcaugccggguugcuggcgcucccuaaagaugacaucccuggccuuccccgguccccuagcggaaagaugaagggucugccguccgugacaccggcugccgcggacccccugaugacgccagaacucgccgacgucuaucgcaccuacgaugcagacaugacgacgucgguggacuuccaagaagaagcgacaauggacacgacaauggcgccgaacucgcugcagaccucgaugccgggaaacaaggcgcaagagcccgagaugaugcacgacgcguggcacuuucaagagccauaaugagcugccuucugcggggcuugccuucuggccaugcccuucuucucucccuugcaccuguaccucuuggucuuugaauaaagccugaguaggaag

SEQ ID NO: 1613 - RNA, 764 nt, Artificial Sequence
  Description of Artificial Sequence: Synthetic coding sequence
gggaaauaagagagaaaagaagaguaagaagaaauauaagagccaccaugggaacauggauucucuuugcgugcuuggugggagcggccuucgcgaugccccugccgccucaucccggacauccgggguauaucaacuuuucguacgagaacucccacucccaagccaucaauguagaucgaaucgcgcucgugcuuacgccuuugaagugguaucaaucaaugauucggccacccuauagcagcuacggguacgaaccgauggguggcuggcuccaccaucagauuauccccguagugucgcagcagcacccgcucacgcauacccugcagucgcaccaccacaucccugucgugccagcccagcaaccgagaguccgccagcaggcauugaugcccguccccggucagcagucaaugacuccgacgcagcaucaucagcccaaucucccgcuuccugcucagcagcccuuccagccucagcccgugcaaccgcagccacaccagcccaugcagccccagccgccuguccaaccaaugcagccucugcuuccacaaccgccacugccgccgauguuccccuugaggccucuucccccaauccugccggaucuucaccucgaggcguggcccgcaaccgacaaaacaaagcaagaagagguagacuaaugagcugccuucugcggggcuugccuucuggccaugcccuucuucucucccuugcaccuguaccucuuggucuuugaauaaagccugaguaggaag

SEQ ID NO: 1614 - RNA, 947 nt, Artificial Sequence
  Description of Artificial Sequence: Synthetic coding sequence
gggaaauaagagagaaaagaagaguaagaagaaauauaagagccaccaugaaagcagcggugcuuacgcucgcuguguuguuccugacaggcucgcaagcgcggcauuuuuggcagcaggacgaaccgccucagucgccaugggaccgcgugaaagacuuggcgaccgucuacguggacgucuugaaggauucgggucgggauuacguaucacaguucgaagggucggcacugggaaagcaguugaaucucaaacuguuggauaacugggacagcgugaccucgacuuuuucaaaacugagggagcaguugggacccgucacccaagaguuuugggacaaccucgagaaggagacagagggguugcgacaggagaugagcaaggauuuggaagaaguaaaggcgaagguacagccuuaucuugaugacuuccaaaagaaauggcaggaagaaauggaacucuaucgccagaagguagagccccuucgggcggaacuucaagagggagcgaggcaaaaacuccacgaacuccaagagaaacuuuccccgcuuggggaagagaugcgcgauagagccagggcgcaugucgacgccuugcgaacgcaccuggcgcccuacuccgaugaguugagacagugccuggccgccaggcucgaagcgcugaaagaaaaugguggugcccggcuggcagaguaucacgccaaggcgacagagcaccucagcacgcuuuccgagaaggcuaaaccggcacuugaggaccuuagacagggacugcuucccgucuuggaaucguucaaggugucauuucugucagcccucgaggaauacacgaagaagcucaacacucagugauaagcugccuucugcggggcuugccuucuggccaugcccuucuucucucccuugcaccuguaccucuuggucuuugaauaaagccugaguaggaag

SEQ ID NO: 1615 - RNA, 947 nt, Artificial Sequence
  Description of Artificial Sequence: Synthetic coding sequence
gggaaauaagagagaaaagaagaguaagaagaaauauaagagccaccaugaaggcggcagucuugacgcucgcgguacucuuucugacagggucacaggccaggcacuucuggcagcaggacgaaccgccucagucgcccugggaccgagugaaagauuuggcgacgguauacgucgauguguugaaggauuccgguagagauuaugugucacaguuugagggaucagcccuugggaaacaacucaaucucaaacuccucgacaacugggacagcgucacauccacguucucgaagcugcgcgagcaacuuggacccguaacccaagaguucugggauaaucuugaaaaagagacagagggguugcgccaggaaaugagcaaggaccucgaggaagugaaggcgaaagugcagccuuaucuugacgacuuccaaaagaaguggcaggaagaaauggaauuguacagacagaaggucgagccacucagggcggagcuucaagaaggcgcucgacagaaguugcacgagcugcaagagaagcucagcccguugggagaggaaaugcgggacugcgcacgcgcccacgucgacgcguugcggacucaucuggccccauacucggaugaacucaggcagcggcuugcugcaagacuugaggcacugaaggaaaacgguggggcucgguuggcggaguaucaugcgaaagccacggagcaccuuuccacccuuucggagaaagcaaaacccgcccuugaagaucugcgccagggauugcugccgguacuugagucguuuaaggugucguuuuuguccgcgcuggaagaguacacuaagaaacugaacacacagugauaagcugccuucugcggggcuugccuucuggccaugcccuucuucucucccuugcaccuguaccucuuggucuuugaauaaagccugaguaggaag

SEQ ID NO: 1616 - RNA, 947 nt, Artificial Sequence
  Description of Artificial Sequence: Synthetic coding sequence
gggaaauaagagagaaaagaagaguaagaagaaauauaagagccaccaugaaagcggcgguccugacgcucgccguccuguuuuugacgggaagccaagcgcggcacuuuuggcaacaggacgaacccccucagucccccugggauagagugaaggaucucgcgacuguguaugucgaugugcuuaaggauucgggaagagacuaugugucacaguucgaaggcucggcacuggggaaacagcuuaaucugaaguuguuggacaauugggauucggucacguccacguucucaaaacuccgcgaacagcuugguccgguaacccaagaguucugggacaacuuggagaaggagacagaagggcugcgacaggagaugagcaaagaccuugaggaagucaaagccaagguacagccguacuuggacgacuuccaaaagaaguggcaggaagaaauggaacucuaccggcagaaaguggagccgcucagagcggagcugcaagaaggggcacggcagaagcuccacgaacuucaagagaaauuguccccacugggagaagagaugcgggaccgcgcacgagcccacguggaugcguugaggacccaucuugcaccuuacuccgacgagcugaggcagcgauuggcagccaggcuugaagcgcuuaaggagaacgguggagcccgccuggcugaauaccaugcaaaggcgacugaacaccucucgacauugucggagaaggccaaacccgcacuugaggauuugagacaggggcuccugcccgugcuggaaagcuuuaagguaucauuucuuucggcgcucgaggaguacaccaaaaagcucaacacacagugauaagcugccuucugcggggcuugccuucuggccaugcccuucuucucucccuugcaccuguaccucuuggucuuugaauaaagccugaguaggaag

SEQ ID NO: 1617 - RNA, 941 nt, Artificial Sequence
  Description of Artificial Sequence: Synthetic coding sequence
gggaaauaagagagaaaagaagaguaagaagaaauauaagagccaccaugaagaaagaggucugcuccguggcguuuuugaaggcaguguuugccgaguuucuggcgacauugauuuucguguucuucggccugggaucggcuuugaaauggcccucggcgcugcccacgauccuucaaaucgcgcuugcguuugggcucgcgaucgggacacucgcgcaggcacuuggcccugugucgggugggcauaucaacccagcgaucacuuuggcccuuuuggucggaaaucagaucagccugcuucgggcauucuuuuacgucgcagcccagcucgucggugcgauugcgggagcggggaucuuguaugguguggcaccguugaacgcaagagggaaccuggccgugaaugcccucaauaacaauacaacgcaaggucaggccaugguaguagaguugauccucacuuuccagcuugcacucugcauuuuugcgagcacggauagcaggcgcacgagccccgucggaucgccugcguugucaauuggacucucagucacucuggggcaccuggugggaaucuacuucacgggguguuccaugaauccggccagaucguucggaccggcgguagugaugaaccgcuuuuccccugcccacuggguauucugggugggucccauugugggggcuguccuugcugccaucuuguauuucuaccugcucuuuccgaacucacucucguugucggagcgcguagccauuaucaagggaacguaugaacccgacgaggacugggaagagcagagggaagagcggaagaaaaccauggaacucacaacccggugauaagcugccuucugcggggcuugccuucuggccaugcccuucuucucucccuugcaccuguaccucuuggucuuugaauaaagccugaguaggaag

SEQ ID NO: 1618 - RNA, 1745 nt, Artificial Sequence
  Description of Artificial Sequence: Synthetic coding sequence
gggaaauaagagagaaaagaagaguaagaagaaauauaagagccaccauggggccaagaggagcggcuucacucccgcgaggaccaggaccuaggcgauugcuucuccccgugguccuuccucugcugcuucuuuugcuucucgcgccaccugguucgggugcgggagccucaagaccgccccaccucguauuucugcucgccgaugaccucggguggaaugacguaggguuccacggaucgcgaauccgaacgccgcaucuugaugcauuggcagcagguggaguacuuuuggauaacuacuacacgcagccauuguguacacccucgaggagccaguugcugacuggccgcuaccagauccggaccggacuucagcaccagaucaucuggcccugucagccgucaugugucccccuugaugagaagcuuuugccucagcugcuuaaagaagcgggguauacgacacauaugguggggaaguggcaccucggaauguacagaaaagaaugccuucccaccagaaggggauucgauaccuacuucgguuaucugcuggggucagaggacuacuacucccacgaacgcugcacgcuuaucgaugcauugaacguaacccgcugcgcccucgacuuucgggauggagaggaagucgccacaggguauaagaacauguauucgacaaacaucuucacgaaaagggccauugcgcugauuacgaaucaucccccggaaaagccccucuuucucuacuuggcgcugcagagcgugcaugagccucugcaagugcccgaggaguaucuuaaacccuacgauuucauccaagacaagaaccggcaccacuacgcgggaauggugucguugauggaugaggcggucggaaaugugacagcggcuuugaagucgagcggacucuggaacaauacgguguucaucuuuucaacugauaaugggggacagacguuggcgggugguaauaacuggccccuuaggggaagaaaauggucgcugugggaagguggagugaggggugucggguuugucgcgagccccuugcugaaacaaaagggggucaagaaccgagaauugauucauaucagcgacuggcugccgacccucgucaagcuggcacgcgggcacacaaacgguacgaagccauuggacggguuugacguguggaaaacaaucuccgagggcucgccuucgccgaggauugaguugcuccacaacaucgaccccaacuuuguagacagcucaccgugcccccgaaauucgauggcgccugcuaaagaugauagcagccugccagaguacuccgcguucaacacuucagugcaugcagcaauucgccacggaaauuggaagcuucugacuggguauccugguuguggcuauugguucccaccgccgucgcaguauaauguaucggagauuccguccucggauccgccgacuaaaacauugugguuguucgacaucgaccgcgaccccgaagagcggcacgaccuuucgagggaauauccccauauugugacgaaguugcuuagccgguugcaguucuaccauaaacacagcguaccgguguauuuuccugcccaagauccucgcugcgaccccaaggccacgggagucuggggucccuggaugugauaagcugccuucugcggggcuugccuucuggccaugcccuucuucucucccuugcaccuguaccucuuggucuuugaauaaagccugaguaggaag

SEQ ID NO: 1619 - RNA, 4541 nt, Artificial Sequence
  Description of Artificial Sequence: Synthetic coding sequence
gggaaauaagagagaaaagaagaguaagaagaaauauaagagccaccaugccggagcaggagaggcagauuacagcgagagagggcgcaucacggaagauccugucgaaacucucgcugcccacccgcgcaugggagccugcgaugaaaaaguccuucgcguucgauaacgugggauacgagggugggcuggauggacuggggccaucgucccaaguagcgacgagcacgguaagaaucuuggguaugacgugccagucauguguaaaguccauugaggaccgcaucucgaacuugaagggaauuaucucgaugaagguaucccuugagcagggaucggcgacugucaaguaugucccuucgguggugugccuucagcaggucugucaccagaucggggacauggguuuugaggcguccaucgccgaaggaaaagccgcauccuggcccagccgaucccuucccgcacaagaagcggugguaaagcuccgcgucgaagggaugacgugucaaucaugcgugucaagcauugaaggcaaagugcggaaacugcagggugugguacgagugaaagugucccugagcaaccaagaggcggugaucacuuaucagccauaucucauccagccagaggaucugcgggaucacgucaaugauaugggguuugaggcagcgaucaaaucgaaaguagcuccccugucgcuggggcccauugauaucgagcggcugcagucaacaaaccccaagaggccccuuagcucggccaaucagaauuucaauaacagcgaaacacucgggcaucaggggucccauguagugacccuucagcuccggauugaugggaugcauugcaaaagcuguguccucaacaucgaggagaauauuggucaguugcuuggggugcagucgauccaagugucgcuugaaaacaagaccgcgcaggugaaguaugauccuucaugcacaucaccgguggcgcugcagagggcgaucgaagcguugccuccgggaaauuucaaagucagccugccggauggggcggaaggaucggguacggaccaccggucaagcuccagccauucacccggcucgcccccaagaaaccagguccaggggacgugcuccacgacucucaucgcaaucgccgggaugacaugugcgucaugcguccacagcauugaggguaugaucucacagcuugagggagugcagcagaucagcgucagccucgcggagggaacggccacaguccucuauaacccuagcgucaucucgcccgaagagcugagagcggcuauugaggacaugggguucgaggcguccguggugucggagagcuguucgacgaacccacuggggaaucacucggcgggaaauucgaugguccaaacgacagauggaacgcccacguccgugcaagagguggcaccacauacgggaagauugcccgcgaaucacgcgccugacauucuugcgaagucgccccagucaacucgcgccguggcaccccaaaagugcuucuugcagaucaagggaaugacgugcgcaagcugcgugagcaacauugagaggaaccuucaaaaagaagccgggguccucucaguccucguggcguugauggcuggaaaggcggaaaucaaauacgacccagagguaauccagccucuugagaucgcgcaguuuauccaagaccucggauucgaagcugcagugauggaagauuacgcggggucagaugggaacaucgagcucacuaucacgggcaugaccugcgcuucguguguccacaauaucgaguccaagcugacuaggacgaacggaauuacauaugcgucaguagcucuggcgacguccaaagcccucgucaaauucgaucccgagaucauuggaccgcgggacaucauuaagauuauugaagaaaucggauuucacgcuagccucgcucagagaaaccccaacgcccaccauuuggaccacaagauggagauuaagcaguggaagaaaucauuccuuuguucccugguguuuggaaucccggucauggcgcuuaugaucuacaugcucaucccuucaaacgaaccucaccaaucgauggugcuggaucacaacauuauuccgggguugucaauccucaaccucaucuucuuuauccuuugcacuuuugugcagcuccuuggcggaugguauuucuaugugcaggcguacaaaucccugcgacacagaucagcaaauauggauguacugauuguccuggcgacaagcauugcguacguauacagcuuggucauuuugguaguggccguagccgaaaaggcagaaagaucaccggucacuuucuucgacacaccgccuaugcuuuuuguguucaucgcucucggacgcuggcuggaacaccuggcaaagagcaagacaucggaagcauuggccaaauugaugucgcuccaggccaccgaggcaacuguggugacguugggggaagauaaccugauuauucgggaagagcagguacccauggaacucgugcagagaggagauauugugaaggucguaccgggugggaaguuucccguagacggaaaaguguuggaagggaauaccauggcggaugagagcuugauuacgggagaagcgaugccugugacgaagaagccuggaucgacagucauugcgggaucgaucaacgcacaugguucgguacuuaucaaagcaacgcacguggguaaugacacuacucuggcccagaucguaaagcucguggaagaagcacaaaugagcaaagccccgauucagcaacuggccgaucgguucagcgguuacuucgugcccuuuaucauuaucaugucgacccuuacacucguaguguggaucguaauuggguucaucgacuuuggagugguccagcgguacuuuccaaauccuaacaaacauauuucgcaaacugaagugaucauccgcuuugcuuuccaaaccucaauuacaguacucuguaucgcguguccaugcucauugggcuuggcuacgcccacggccguaaugguagggacgggagucgcagcgcagaauggaauccugaucaagggcgggaaaccccuugagauggcacacaaaaucaagacagucauguucgacaagacggggacaauuacucacggugugccccggguaaugcgcguguuguugcucggggacguggcgacauugccgcugaggaaggucuuggcggucgugggcacagcggaagccucgucggagcacccgcugggaguggcgguaacgaaguauugcaaagaggaacucggcacugaaacgcugggcuacugcacagauuuucaagccgugcccgguugcgggauuggcuguaaagugagcaauguggaagggauucucgcgcacucagagcgaccacucucggcaccggcuucgcaucucaaugaggccggaucccugccagccgagaaggaugcugucccgcagaccuuuuccguguugaucggcaaccgggaguggcuuaggcgcaacggguugacgauuucgucggaugugucagacgccaugacagaucaugagaugaagggacagacagcgauccuggucgcgauugacggaguguugugcgguaugauugccaucgccgaugcgguaaaacaggaagcggcgcucgcuguccacacgcuccagucaauggggguagacguagugcugaucaccggggacaaccgaaagaccgcucgcgccaucgccacgcaagucgggauuaacaagguguucgccgaggugcuccccucgcacaagguagcaaaaguacaagaacugcaaaacaaagggaagaagguagcgauggugggggauggugugaacgacucgccggcacucgcucaggcggacauggguguagccaucggaacaggaacugacguagcuaucgaggcggccgacguaguccucauuaggaaugaccucuuggacgucgucgcaucgauccaucuuucgaagcgcacugucaggcgcaucaggauuaauuuggugcuggcccugaucuacaacuuggugggaauccccaucgcagcgggaguguucaugcccaucgguauuguacugcagccauggauggggucggccgcaauggcagcgucaagcguaucgguaguauugagcuccuugcagcucaagugcuacaagaaaccugacuuggagcgcuacgaggcacaggcgcacggccauaugaagccgcuuacggcaucccaaguguccguccacauugggauggaugauagguggcgggauucacccagggcaacacccugggaccaggugucauauguaucgcaggugucgcucucgucccuuacaucggauaagcccucaaggcacagcgcggcugcggacgacgauggugauaaauggucacuccugcugaauggacgcgacgaagaacaguacauuugaagcgcugccuucugcggggcuugccuucuggccaugcccuucuucucucccuugcaccuguaccucuuggucuuugaauaaagccugaguaggaag

SEQ ID NO: 1620 - RNA, 656 nt, Artificial Sequence
  Description of Artificial Sequence: Synthetic coding sequence
gggaaauaagagagaaaagaagaguaagaagaaauauaagagccaccaugaaaacacaacgggauggacacucgcuuggacgcuggucccuugucuuguugcugcucggccucgugaugccucucgccaucauugcgcaagugcucucauacaaagaggcugucuugagagcgaucgaugguaucaaccagagaucgucagaugccaaucuguaucgguugcuggaccuugacccccgaccaacaauggacggggauccggauacccccaagcccgugagcuuuaccguaaaagaaacgguguguccgaggacuacucagcagucccccgaggacugcgauuucaagaaggacgggcucgucaagcgguguauggggacgguaacgcugaaccaggcgaggggaucauucgauauuucgugcgacaaggacaacaaacgguuugcacuucuuggugacuuuuuccgcaagucgaaagagaagaucggaaaagaauucaagaggaucguccagcgcauuaaggacuuuuugagaaaucucgugccgcgaacagaaagcuaaugagcugccuucugcggggcuugccuucuggccaugcccuucuucucucccuugcaccuguaccucuuggucuuugaauaaagccugaguaggaag

SEQ ID NO: 1621 - RNA, 3341 nt, Artificial Sequence
  Description of Artificial Sequence: Synthetic coding sequence
gggaaauaagagagaaaagaagaguaagaagaaauauaagagccaccaugaaaauccuuauucucgggauuuuccuguucuugugcucgacaccggcaugggccaaagaaaagcacuacuacauugggauuaucgagacaacgugggauuaugcgucggaccauggggagaaaaaguugaucucgguggacacggaacacucaaacaucuaccuccaaaauggaccggacagaaucggacggcucuacaagaaggcauuguaccuccaguacaccgaugaaacuuuucgaacaacaauugagaaaccugucuggcugggcuuucugggacccaucauuaaggcugagacuggggauaagguguauguccaccucaagaaucuugcguccaggccguauacuuuccauagccauggaaucacauauuacaaagaacaugagggggcgaucuacccagacaacacgacggacuuucagcgggcagacgacaaaguguacccgggugaacaguauacuuauaugcuccuggccacggaggaacagucaccgggcgagggcgacggaaauugcguaacgcggaucuaccacucccacauugacgcgccuaaagauaucgcgucgggauugauugguccgcucaucauuugcaaaaaggauucccuggacaaagagaaggaaaaacauaucgaucgcgaauuuguggucauguucagcguggucgaugaaaacuuuagcugguacuuggaggauaacaucaagacauacuguagcgagcccgaaaaaguggauaaggacaacgaagauuuccaagaguccaauagaauguacucggugaacgguuauacguucggcucccugccgggacuguccaugugcgcugaggaccgcgugaaaugguacuuguuugguauggggaacgaaguggaugugcacgcggcguucuuucacggccaagcguugacgaacaaaaacuacagaaucgauacgaucaauuuguuccccgcaacguuguuugaugcguacaugguggcgcagaacccgggagaguggaugcuuucgugucaaaaucucaaucaucuuaaagcagggcuucaagccuuuuuccaagugcaagaauguaauaagucaucauccaaagauaacauuagggguaaacacguacgccacuauuacauugcggcggaggagaucaucuggaauuacgcgccgucagggaucgacauuuucacaaaagagaacuugaccgcaccagggucagauucagcaguguuuuucgagcaggggacaaccagaaucggcggaagcuauaagaaacuuguguaccgggaguacacagacgccuccuuuacgaauaggaaggagagaggucccgaagaggagcacuuggggauucuugggccggugauuugggcggaaguaggggauacuauccgggucaccuuccacaacaagggggcguauccgcugucgaucgaacccauuggagugcgguucaauaagaauaaugagggaaccuacuauucgcccaacuauaacccccagucacgcucggugcccccuucggccucccauguggcucccacggaaacguucacguaugaauggacuguacccaaagaagugggaccaaccaacgcggaccccgugugucuggcgaagauguauuacuccgcgguggacccuacgaaggacaucuuuacgggacugauuggaccuaugaagauuuguaagaagggaucguugcacgccaacgguaggcagaaggaugucgacaaggaguucuacuuauuuccuacuguguuugaugagaaugagucacuucuccuugaggacaauauucggauguucaccacugcgccagaccagguagacaaagaagaugaggauuuucaagaaucaaauaagaugcacucgaugaaugguuucauguacggaaaccaacccggccugacaaugugcaagggggacagcguagucugguacuuauucucagcaggaaacgaggcugacguccacgggaucuacuuuagcggaaacaccuauuuguggaggggugaacggagggauaccgccaaccuuuucccgcagacuucccucacgcuucauauguggcccgacacagagggaacuuucaaugucgaaugccuuacaaccgaucauuauaccggugguaugaaacagaaguacacgguaaaccaaugucggaggcagucggaagauucgaccuucuacuugggggagaggacguacuauaucgcggcagucgaggucgaaugggauuacucgccccaacgggagugggaaaaggaacugcaccaucuccaagagcagaaugucagcaaugcguuccuugacaaaggagaguuuuacaucggaucgaaguauaagaaggucguauaucgccaauacacggauuccacguuccgggugccggucgaaaggaaggcagaggaggagcaccuuggaauccucggaccgcaguugcacgcggaugugggugacaaggugaagauuaucuucaagaauauggccacucggcccuauuccauucacgcccacggugugcagacagagagcucgacagucacgccaacacuucccggagagacucuuacguaugucuggaaaauuccagaacgcagcggagcaggaacggaggacucagccugcauccccugggccuacuacucaacgguagaccaaguaaaggacuuguacagcgggcucaucggucccuugauugucuguagacgaccguacuugaaagucuuuaacccccgacgcaaacuugaauuugcucuucucuuucuuguguucgacgagaacgagagcugguauuuggacgacaacauuaagacauacagcgaccaccccgagaaggucaauaaggacgacgaagaguuuaucgaaucaaacaaaaugcacgcgaucaauggucgcauguuugggaaucuucaaggucuuacaaugcacgugggcgaugaggugaacugguaucucaugggaaugggaaacgagaucgaccuccacacuguacacuuucauggacacucauuucaguauaagcaccggggagucuauucaucggauguauucgacaucuuucccgggacguaucagacgcuggaaauguucccgcggacgccgggaaucuggcuccuucacugccauguaacggaccacauccaugcagggauggaaacaacauacacuguacugcagaaugaggauacuaagagcgguuaaugagcugccuucugcggggcuugccuucuggccaugcccuucuucucucccuugcaccuguaccucuuggucuuugaauaaagccugaguaggaag

SEQ ID NO: 1622 - RNA, 1536 nt, Artificial Sequence
  Description of Artificial Sequence: Synthetic coding sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 1623 - RNA, 1544 nt, Artificial Sequence
  Description of Artificial Sequence: Synthetic coding sequence
gggaaauaagagagaaaagaagaguaagaagaaauauaagagccaccauggucagccaggcacucagacugcucugccuguugcuugggcugcaggguugcuuggccgcugggggagucgcgaaagcgucggguggagaaacgcgggacaugccauggaagccuggaccccaucgcguauucgugacacaagaagaagcccacggaguguugcauagacggcgcagagcaaacgccuuucucgaagagcucagaccggggucgcucgagagggaguguaaggaagagcaguguuccuuugaagaagcacgcgaaaucuucaaagacgccgaacgaaccaagcuguuuuggaucucguauucagauggagaucagugugccucaucgccgugucaaaaugggggaagcugcaaagaucagcuucagagcuacauuugcuuuuguuugcccgcguucgaggggcggaacugugagacucacaaagaugaccaacugaucugcgucaacgagaauggugggugcgagcaguauugcuccgaccacaccggcacaaaaagaucaugccgcugucacgagggauauucgcugcucgcggacggagucagcuguacgccgacagucgaguauccaugcggaaagauuccgauucuugagaaacgcaaugccucgaagccccaggggcggaucgucgguggaaaagugugcccgaagggggagugccccuggcaggugcuccucuuggugaauggagcccaguuguguggcggcacguugaucaauacaaucuggguaguaucggcugcccauugcuucgacaaaaucaaaaacuggcgaaaccugauugcggugcugggugaacacgacuuguccgagcacgauggggacgagcagucgaggcggguagcgcaagucaucaucccauccaccuacgucccuggaacaacuaaccacgauauugcacugcucaggcugcaccaacccgucguguugacggaucauguggugccccuuugucuccccgagagaaccuucagcgagagaacguuggccuucgugcgguucucgcuugugucggggugggggcagcuucucgauaggggagcgacagcuuuggaacugaugguacugaacguaccgaggcuuaugacccaagacuguuugcaacagucgcgcaaggugggagauucgccgaauaucacugaguacauguucugugcggguuacuccgacggaucaaaggacucaugcaagggugauagcggugguccccaugcgacgcauuaccgagggacgugguaccuuacgggaaucguaucaugggggcagggaugcgcgacgguggggcacuuuggugucuacacucgcgucagccaguauauugagugguugcagaaguugaugaggagcgaaccucggccuggagugcugcucagggcaccguuuccuugauaagcugccuucugcggggcuugccuucuggccaugcccuucuucucucccuugcaccuguaccucuuggucuuugaauaaagccugaguaggaag

SEQ ID NO: 1624 - RNA, 7199 nt, Artificial Sequence
  Description of Artificial Sequence: Synthetic coding sequence
gggaaauaagagagaaaagaagaguaagaagaaauauaagagccaccaugcagaucgagcucucgacaugcuucuucuugugccugcuucgcuuuuguuuuucggcaacgaggcgcuacuaccuuggugccguggaacuuucaugggacuacaugcagucggaucuuggagaacuuccaguggacgccagguuuccaccucgggugcccaagucauuucccuuuaacacaucggugguguacaagaaaacauuguucguggaauucacagaccacuuguuuaacauugcgaagcccagaccgccguggauggguuugcucggcccgacgauccaggcggaagucuacgacacgguagugaucacgcucaagaacauggccucgcaucccguaucacuucacgcaguaggagucuccuauuggaaagcguccgaaggggcagaguacgaugaucaaacaucacagcgcgagaaggaagaugacaagguguuuccggguggaucgcauacauauguguggcagguccuuaaagagaacggacccauggcaucagauccucuuugccucacguacucguauuugucgcauguagacuuggucaaggacuugaauucaggucuuauuggagcauuacuuguuuguagagaagguucucuggcuaaagaaaagacacagacauugcacaaguuuauccugcuuuucgcgguguucgacgagggaaaaucauggcacucggaaacgaaaaacucccuuaugcaggauagggacgcagcgucggccagagccuggcccaaaaugcacacugucaacgguuaugucaacagaagccuucccgguuugaucggaugccacagaaaaucgguguacuggcacgugauugggauggggacgacgcccgaaguacacuccaucuuuuuggaagggcacaccuuuuugguacgcaaccauagacaggcaucccucgagauuucgccuauuacuuucuugacggcgcagacguuguugauggacuugggucaguuuuugcucuuuugccacaucucgucgcaucagcacgauggaauggaagcguacgucaagguagacagcuguccggaagagccgcaauugaggaugaagaauaacgaagaagccgaagauuaugaugacgauuugacagacucagaaauggacgucgugcgauucgacgaugacaauagcccgagcuucauccagaucagaucagucgccaaaaagcauccaaagacauggguacacuacaucgccgcugaagaagaggacugggauuaugcaccuuuaguucuggcuccugaugauagaucuuacaagucacaguacuugaacaacgguccgcagcggaucggaagaaaguacaaaaagguccgcuuuauggccuauacagacgagacauucaagaccagggaagcaauucagcaugagagcggaauucucggaccucugcucuauggagaggucggugacacgcuguugaucaucuucaaaaaccaggcaucaaggcccuacaacaucuauccgcacgguauuacugacguccggccucucuacucccgcagacuccccaagggagugaaacaucuuaaagauuuucccauucugccuggggagaucuucaaguauaaguggacagugacggucgaggaugguccaaccaaaucagacccgagaugucugacgcgguauuacucgucauucgucaauauggagcgggacuuggccucgggguugauuggaccacuccucauuugcuacaaagaaagcgucgaucagcgcgguaaccagaucaugucggauaagcgcaacgucauccuuuucucggucuuugaugaaaaucgcucgugguaucucacggagaacauccagagguuucugccgaauccagcgggaguacagcuugaggaccccgaguuccaggcgucgaacaucaugcauagcaucaacggguaugucuuugauagccuucaguugagcgugugucuucaugaggucgcauacugguacaucuugagcaucggagcgcagacggacuuuuugucgguguucuuuagcggauacacauucaaacauaagaugguguaugaagauacacugacucucuuucccuucucgggagagacagucuucaugucgauggagaaccccgguuuguggaucuuggggugucauaacucggauuucagaaaucgcgggaugacagcuuugcugaagguguccagcugcgacaagaauaccggagacuauuacgaagacucguaugaggacaucagcgcguacuugcucucaaagaacaaugcgauugaaccuaggucauucucgcaaaacucacggcauccuucgacucgacagaaacaguucaaugcgaccacgauccccgagaaugauaucgaaaagaccgacccuugguuugcacacagaacccccaugccuaagauccagaacguaucauccagcgaccugcuuaugcuucuuaggcaaucuccuacaccucauggauuaucgcucuccgaucuccaagaagcgaaguacgagaccuuuucggaugacccuucccccggugcaauugacucaaacaauuccuuguccgagaugacacacuuccgaccccagcuucaccacagcggagacaugguguuuacccccgaaucgggacuucaacugaggcuuaacgagaaacucgggacaacagcugcgaccgaguugaaaaagcucgauuucaagguaucaucaacaucgaacaaccugaucuccacgaucccauccgauaacuuggcagccggaacggacaauacgucaucgcucggaccgccaucgaugccggugcacuaugauucgcaauuggacacuacucuguucggaaagaagucgucgccuuugacggagagcggugggccucucucacucucagaagagaacaacgauucgaaacugcucgaaagcggacuuaugaacucccaagaguccucaugggggaagaacgugagcucaacagaaucagguagacuguuuaaaggaaaacgagcucaugguccugcacuccugacuaaagacaaugcgcucuucaaggugucgaucucgcucuugaaaaccaacaaaacauccaacaacucggcgaccaaccgaaaaacccacauugauggucccucgcuucugauugaaaacucgccgucgguguggcagaacauucuugagucggauaccgaguuuaagaaggucacaccguugauccacgaccgcaugcugauggacaaaaacgcgacggcucugagguugaaucauaugucgaacaagaccacuucgagcaagaauauggaaauggugcagcaaaagaaggaaggaccuauuccgcccgacgcgcagaaucccgauauguccuuuuucaagaugcuguuucugccugaaucagcaagauggauacaacguacacauggaaaaaauucucuuaacucuggccaaggaccuaguccaaagcaguugguguccuugggucccgaaaagucaguggaggggcagaacuuucucuccgaaaagaacaaaguggucguggggaagggagaauucacaaaggauguggggcucaaggagaugguguuuccguccucgcgaaaccuuuucuugaccaaucuggauaaccuucaugagaacaacacucacaaccaggagaagaagauucaggaagaaaucgagaagaaagaaacacuuauucaggaaaaugucguccugccccagauccauaccgugaccgggacgaagaacuuuaugaagaaucucuucuugcuuagcacaaggcagaacgucgaggggagcuacgauggagcguaugcgccggugcugcaggauuuucgcucauugaacgauucaaccaauagaaccaagaaacauacggcgcacuucucgaagaaaggggaagaagagaaucuugaggggcucggcaaucagacuaaacagauuguggagaaauaugcguguaccacucgaauuucccccaauaccucgcaacagaauuuugugacucagaggucgaagcgggcauugaaacaguuucgguugccucuugaagagacugaauuggagaagaggauuaucguagacgauacaagcacccaguggucgaaaaacaugaagcaccugacacccucgacgcugacgcagaucgacuauaaugagaaggagaagggagccaucacccagucgcccuugucagauugucugacgagaucacauucgaucccgcaagcgaaucguaguccacuuccaauugcaaaaguuagcucauuuccuucuauucguccuaucuaccugacuaggguccucuuccaagauaauucaagccaucugccagcagcaagcuauaggaagaaagacucgggggugcaggagucaagccacuuucugcaaggggcgaagaaaaacaaucuuucccucgcgauccucacauuggagaugacaggugaccaacgcgaaguggggucgcucggaacaucggcuacgaauucagucacauacaagaagguagaaaacaccguccugccgaagccggauuugcccaaaacuuccgguaaagucgagcuucugcccaagguccauaucuaccagaaagauuuguucccgacggagacaucaaacggcuccccgggacaucucgaccuuguagagggaucgcugcuucagggaacugagggugcgauuaaguggaacgaggcgaauaggccugggaaggugccauucuugcgcguagccacggaaucgagcgcgaagacuccaucgaaacucuuggauccucuugcgugggacaaccauuacgggacacagaucccuaaggaagaauggaagucacaagaaaaguccccggagaaaaccgcauucaaaaagaaagacacuauccuuucgcuuaacgcgugugagucaaaucacgcgauugcggcgaucaaugaggggcagaacaagccugaaaucgaagucacgugggcaaaacaggggcgcaccgaacggcuguguucgcaaaauccgccugugcuuaagagacaucagagagagauuaccagaaccacacuccagucagaccaggaagagaucgacuacgacgauaccauuucagucgagaugaagaaagaggacuucgauaucuacgacgaggaugagaaccagucaccucggucauuccagaagaagacacggcauuacuucauugcagcaguggagcgcuugugggacuauggaaugucuucaaguccucauguucuaagaaauagggcucaaucgggaucgguuccucaguucaaaaagguaguguuucaggaauucacggacgggagcuucacacagccccuguauaggggugaguugaacgagcacuugggacuccucgguccguacauuagagcagaagucgaagacaacaucauggugacauuccggaaccaggccucgcgacccuauagcuucuauagcagccucauuucguacgaagaagaucagagacaaggggcggagccccgaaagaacuuugugaagccgaaugaaacaaagaccuauuucuggaaagugcagcaucacauggccccaacaaaagacgaguucgauugcaaggcuugggccuacuuuuccgauguggaucucgagaaagacguccacucgggacugaucggaccccuucuggucugucauacaaauacucuuaacccugcgcauggucgccaggugacggugcaagaauucgcucuuuucuuuaccauuuucgacgaaacaaaguccugguacuucaccgaaaacauggaacgaaauugcagagcgccuuguaacauccaaauggaggaucccacguuuaaagaaaacuaucgcuuccaugcaaucaaugguuacaucauggacacgcuccccggacuugugauggcccaagaccagagaauucgaugguacuugcuuucgaugggaagcaaugagaacauucacucgauccauuucagcggacacgucuuuaccgugcgcaagaaagaagaguauaagauggcgcucuacaaucuuuacccggguguguucgaaacaguggagaugcugcccucgaaggcggguaucuggcgcguggaaugucugaucggcgagcaccugcacgcgggaaugucgacguuguuucuuguguacucgaacaaaugucagacgccucucgguauggcgagcgggcauauccgggacuuucagauuacggcgucagggcaguacggacagugggcaccuaaacuggcacggcuccacuacagcgggucaaucaacgccuggucgacgaaagaaccuuucagcuggaucaaaguggaccuucuggccccuaugaucauucauggaaucaagacccagggagcccggcagaaguucucguccuuguauaucucacaguuuaucaucauguacucgcuugaugggaagaaauggcaaacguacaggggaaacucgacggggacucugaugguauucuucgggaacgucgacucgucgggaaucaaacacaacaucuuuaacccacccaucauugcgcgauacauuagacuccaccccacccauuacucaaucaggucgacuuugcgcauggaacugaugggaugugaccucaauucgugcucgaugccacuggggauggagucaaaagccauuucggacgcacagaucaccgccagcucauacuucaccaauauguucgcaacguggucgcccucgaaagcgaggcuccaucuccagggaaggucgaaugcguggcgaccgcaagugaauaaccccaaagagugguugcaggucgauuuccagaaaaccaugaaggugacagggguaacgacacagggggugaaaucacugcucacuucgauguacgugaaagaguucuugaucagcucgucccaagauggacaucaguggacacuguucuuucagaacgggaaggucaaaguguuccaggggaaucaggauagcuucacgcccgucguaaacucauuggaucccccacucuugacacgcuauuugcgaauccacccacaaucgugggugcaccagaucgcacuccggauggaaguccuugguugugaagcgcaggaucuguacugaugagcugccuucugcggggcuugccuucuggccaugcccuucuucucucccuugcaccuguaccucuuggucuuugaauaaagccugaguaggaag

SEQ ID NO: 1625 - RNA, 2021 nt, Artificial Sequence
  Description of Artificial Sequence: Synthetic coding sequence
gggaaauaagagagaaaagaagaguaagaagaaauauaagagccaccaugaucuuccucuaucaggucguccauuucaucuuguucacgucgguguccggcgaaugcgucacgcaguuguugaaggacacgugcuuugaaggaggagacauuacaacgguguuuacgccauccgcgaaauacugucagguggucuguaccuaccauccccggugucugcuguuuacauucacugccgaauccccuagcgaggaccccacucggugguucacgugugugcuuaaggauuccgucaccgaaacacuuccucgggucaaucggacagcggcgaucucgggguacucguucaagcaaugcucacaccagauuuccgccugcaacaaagacaucuacgucgaucucgauaugaaaggcaucaacuacaacuccucgguggcaaagagcgcacaagagugucaagagcgaugcacagacgacgugcacugccacuucuucacauacgcgaccaggcaguucccaucgcuggaacacagaaacaucugccuccucaagcauacucagacgggaacucccaccaggauuacgaagcuggauaaggugguaucgggauuuucccuuaagucaugcgcccuuagcaaccuggcguguaucagggacaucuuucccaauacaguauuugccgauuccaauauugacucagugauggccccugacgccuucguguguggccgcaucugcacacaucaccccggaugucucuucuucaccuucuuuagccaggaguggcccaaggagagccagaggaaccucugccuucucaaaacgucggagucaggauugcccucgacgcggaucaagaaaucaaaggcgcuuucgggguucucguugcagagcugucgccauagcauuccagucuuuugucacucaucguuuuaucacgacacugauuuucucggggaagaguuggacaucguggcagcaaagucgcaugaagcgugccagaaguuguguaccaacgccguccgcugccaguuuuucacauacacuccggcccaggcuucgugcaacgaggggaagggaaagugcuauuugaagcucagcuccaauggcucgccuaccaaaauucuucacggacgaggcggaaucucaggguacaccuugagauuguguaagauggacaacgaauguacuacaaagaucaaaccgcgaauuguaggcggaacggcgucgguccggggagaauggccguggcagguaacauugcauacgaccucccccacccagagacacuugugcggugggucaauuaucgggaaucaguggaucuugaccgcagcccacugcuuuuauggaguggaguccccgaaaaucuugaggguguacucagggaucuugaaccagucggaaaucaaggaggacacaucauucuucgggguccaagagaucaucauucacgaucaguacaagauggcggagucgggguacgauauugcgcuucugaaauuggaaaccaccgucaacuacacugauucgcagcggccgaucugccugccuagcaaaggggaccggaaugucaucuacacagauuguuggguaacggguugggguuaucgcaagcugcgagacaaaauccagaauacacugcaaaaagcgaaaauuccguuggugacuaacgaggagugucagaagagauauagaggucacaaaaucacccacaagaugaucugcgccggauaccgggaaggggguaaagacgcauguaaaggagauagcgguggcccguugagcugcaagcauaacgagguauggcaccucguggguauuacuucauggggagaaggcugugcgcagcgcgagaggccgggugucuauacuaauguaguagaguauguggacuggaucuuggagaaaacucaagcagucugaagcgcugccuucugcggggcuugccuucuggccaugcccuucuucucucccuugcaccuguaccucuuggucuuugaauaaagccugaguaggaag

SEQ ID NO: 1626 - RNA, 9003 nt, Artificial Sequence
  Description of Artificial Sequence: Synthetic coding sequence
gggaaauaagagagaaaagaagaguaagaagaaauauaagagccaccaugacgcuucgguuguugguagcagcccucugcgcgggaauucucgcugaggcaccucgggugagagcgcagcauagagagcgaguaacauguacucgacuguacgcggcagauaucguguuuuuguuggacgguucguccucgauuggucggucgaacuuucgggaagugaggucguucuuggaaggacucguacuucccuuuuccggggcugccucggcgcagggggugcgcuuugcgaccguccaguauucagacgaucccagaaccgaguuuggucuggacgcgcugggaucagguggugacguaauccgagccauucgcgagcugucauacaaaggcggaaauacgagaaccggugcggcgauccuucacgucgcugaccacguauuccugccgcagcucgcaagacccggaguaccgaaaguguguauccugaucacggaugggaaaucccaggaccuuguggacacggcugcacagcgguugaaaggccagggugugaagcucuucgcggucgguaucaaaaacgcagacccagaagagcuuaagcggguggcaucccaaccgacaucggacuucuucuuuuucgucaacgacuucucgauucuucggacucugcucccgcuugugagccgaaggguauguacgacagccgguggugucccugugacacgaccgccugaugacagcacgagcgccccuagggaccuggugcuuucggaacccucaucacagucacugagaguccaauggacugcggcaucggguccgguaaccggguauaagguacaguacacuccguugaccggucuggggcagccccuuccgucggaacgccaagaagucaacgugccagcaggcgaaacuucagugaggcugcgagggcuccgaccucucacggaauaucaggugaccgugaucgcgcuguaugcaaacuccaucggagaggccguaucagggacagcucggacgaccgcucuugaaggacccgaacucacgauccagaauacaacagcgcacucacuucuuguggcauggcgcucgguccccggagccacaggguacagagugacauggagaguacugucgggagguccgacgcagcaacaggagcucgguccagggcagggaucaguauugcuucgcgauuuggagcccgguacggacuaugagguaacgguaucaacacuuuucggaagauccguaggacccgccacgucauugauggcgcgaacggacgccagcgucgagcagacuuugcgcccaguaaucuugggaccaaccucaauccugcucagcuggaaucuugugccggaagcucgaggguaucggcucgaauggcgaagagagacuggauuggaaccgccacaaaaggucguauugcccucggacgugacaagguaccaguuggauggacuucagccugggacugaguaccggcugacccucuacacacuguuggaagggcacgaaguagccacucccgcgacgguggugcccaccggaccggagcugccggugagcccagucacagaucuccaggcgacggaacucccuggucagagagugcgagucucauggucaccggugccgggagccacgcaguacagaaucauuguccgaucgacccaaggcgucgagcgaacccuugugcuucccggaucgcagacugccuucgaucuggacgacgugcaagcaggacugagcuauacggucagagugucagcgagagucggaccccgcgagggaucagcguccgugcugacugucagaagggagcccgaaacgccgcucgcggugccuggccuuagagucguagugucggaugcgacgagggugcgagucgcgugggguccagugccuggggcgucggguuuucggaucucguggucgacggggagcggucccgaauccucgcagacucucccacccgauagcacagcgacagauaucacagggcuccaacccggaacgacguaucaagucgcagucagcguguugagagguagagaggaaggcccugcagcggucaucguagcgcgcacggacccacuuggaccagucagaacaguacacguaacucaagcaucguccucguccguaacuaucacguggacaaggguaccaggugcgacaggauacagagugucguggcacucggcacacgguccagagaaaucgcagcucguguccggagaagcuacggucgcggaacuggacggccuugaacccgauaccgaguacacagugcaugucagagcucacguggccggagucgaugggccaccggcgucgguggucgugcgcacagcaccagagccggugggacgcgugucccggcugcagauucuuaaugccagcucggaugucuugcgcaucacaugggucggcguaacgggugcgacggcguaucgguuggcguggggaaggucagagggcggaccgaugcggcaccaaauucucccuggaaacacagauucggccgaaaucagaggacucgagggaggcguaagcuacuccguccgcguaacagcuuuggugggggauagagaagguacucccgugucaaucgucgugacuacacccccugaagcuccgccugcguugggaacuuugcaugucguacaacgcggggagcacagccuucggcugcgaugggagcccgugccaagagcccagggguuucucuugcauuggcagccggagggaggacaagaacagucaagaguccucggcccagagcucagcuccuaucauuuggacggacucgagccggcgacgcaauaccgcguaagguuguccgucuuggggccugccggggaaggaccguccgcggaggucacagccagaacggaaucgccgagaguacccucgauugagcugcgaguaguggacacguccauugauucggucacuuuggccuggacaccgguaucacgcgccucaagcuacauccugucauggcgaccgcuucgcggacccggacaggaagugccaggaucaccucagacgcuccccggaaucagcucgucgcagcgcgucacgggucuggagccuggagucucauacaucuuuagccucacacccguacuugauggcgucagaggacccgaggcaucggugacccagacaccagugugcccuagaggacuggcggacgugguguuucugccacacgcgacacaagacaaugcgcaccgggcugaagcuacgcgaagggugcucgaaagacuggugcuugcgcucggaccucuuggaccccaggcaguacaagugggguugcucucauacucccacagaccuucgccguuguucccgcuuaaugggucgcaugaucucggaaucaucuugcagagaauccgcgauaugcccuauauggauccaagcggaaacaaccucgggacagcgguagucacggcgcaccgguacauguuggcgccugaugcuccaggccgaaggcagcaugugccgggugucauggugcugcuggucgacgagccgcugaggggagacauuuucucacccauuagagaggcccaagccagcggguugaauguggucaugcucgguauggcuggagcagaucccgagcagcuccgacgacuggcacccggaauggauucggugcagacguuuuucgccgucgacgauggacccucauuggaccaggccgugagcggacucgcaacggcauugugucaggcgucguucacgacgcaaccuagaccggaaccguguccgguguauugucccaagggacagaagggggaaccuggcgagaugggucugagaggucagguggguccgccuggcgacccggguuugccuggccgcacgggagcgccugggccacaaggaccgccuggguccgcaacagccaaaggggaaagaggcuuucccggagcggauggacggccagggucgcccggaagggcggguaaccccgguacacccggugcacccgggcucaaaggcucgcccggacuuccuggucccagaggcgauccaggcgaacgcgguccgagaggaccgaagggugagccaggagcgccaggacaggucaucgggggugaagggccugggcugccaggacgcaagggcgacccggguccgucagguccgccugggcccagagggccucucggugaucccgguccucggggaccaccgggguugcccggaacggcgaugaaaggcgacaagggagauaggggcgaaagggggccgcccggaccaggagaggguggaaucgcgccaggggaacccggacugccgggacugccuggaucccccggaccgcagggaccagucggaccgccugggaagaaaggggagaaaggugauagcgaggacggugcuccugguuugcccggacagccggguucaccgggagaacagggucccagagguccaccgggagccauugggcccaagggggacagggguuuucccggacccuugggcgaggcaggggagaagggcgagcgaggaccacccggccccgccggaucccgaggucugccaggggucgcgggaaggccuggugcgaaggggccugaaggaccaccgggacccacgggaaggcagggcgagaagggcgaaccaggucgaccgggggacccagcugucguagggccugcgguagcgggaccaaaaggcgagaaaggggacguagguccagcaggaccacgaggcgcuacggggguacagggagagcgaggcccucccggucuggucuugccaggcgaccccggacccaagggagauccgggugacaggggaccaauuggacuuacggguagagcggguccacccggcgacucaggcccuccaggggaaaagggggaucccgggaggccuggucccccugggccgguaggaccccgagggagagauggagaggugggugagaagggagaugaagguccaccuggugauccggggcuccccgguaaagcuggggagagggggcugcgcggagcaccuggcguacgcggucccgugggggaaaagggggaucagggcgaccccggugaggacgggagaaacgggucacccgguucaucagggccgaagggcgacaggggugagccgggaccgccagguccaccggggagguugguagauacaggcccuggagcgagagagaaaggcgagccgggagaccgagggcaggaagguccgagagggccuaaaggggauccugggcuuccuggugccccuggagaaagagggauugaggguuuccgcggaccgccgggaccccagggugauccgggagugcggggaccggcuggagaaaaaggcgauagaggcccacccggucuugaugguaggucggguuuggaugggaagccgggagcggcaggaccgucgggaccgaacggugcggcugggaaggcgggagauccuggucgcgacggguugccugggcucagaggcgagcagggacucccgggaccauccggaccaccuggucugcccggaaaacccggagaagauggaaaaccgggacuuaauggaaagaauggugaaccaggggacccuggugaagacgguaggaaaggggagaaaggugacuccggugcaagcggacgagagggacgcgaugguccgaaaggggaacgcggagcccccgguauucuggguccucaaggucccccuggguugccggguccaguggguccaccugggcaggguuucccuggcgucccgggugggacagggcccaagggcgaccgcggugaaacuggaagcaagggagaacaagggcugccgggagagagaggacuucggggagagccgggaucgguacccaauguagaccggcugcuggaaacggcagggauuaaggcuagcgcccuuagagagaucguagaaacuugggacgagucaagcggaucguuuuugccaguacccgagcgcagacggggucccaagggugacucaggcgaacagggaccaccaggaaaagaagggcccauuggguuuccgggggagcgaggucugaagggcgaucgaggugaccccgguccucagggaccgccaggacuugcgcugggugagcgcggucccccuggaccgucagggcuggcaggugaaccaggaaagcccggaaucccuggccugcccggucgagcggguggugucggugaagcggggagaccuggugagcggggugagaggggcgaaaaaggagagcgcggugagcaaggacgggacggaccaccgggauugcccggcacgccagggccacccggaccuccgggaccuaagguguccguggaugagccuggaccgggacucucgggagagcagggcccaccuggcuugaagggggccaaaggugaaccgggaucgaacggagaccaaggucccaaaggcgaccggggugugcccggcauuaagggagauaggggcgaaccugggccucgaggucaggacgguaacccagggcugcccggagagagagggauggcagggccggaagggaagccuggcuugcaaggacccagggguccucccggaccggucggaggucauggagauccugguccuccgggugcgccaggcuuggcuggaccugccggaccccaagggcccucgggacugaaaggugagcccggagaaacaggcccacccggucggggauugacagguccgacuggcgcagucggacugccagggccaccagguccguccggacuggugggaccacaggggagcccaggacuuccuggccaggucggggaaacugguaagccuggggcuccaggacgcgacggcgcaucgggcaaagauggagaucgcggcucacccggugucccggguucaccaggacugcccggacccgugggaccgaagggugagccugggccuacgggggcgccgggacaggcuguggugggucuuccgggagcgaagggggagaagggggcacccggugggcucgcgggugaucuugugggugagcccggagcaaagggagacagaggauugccgggaccacggggugaaaagggagaagcaggucgcgcuggggagccuggugaccccggagaggacggacagaaaggggcaccugguccuaagggcuucaagggagacccgggagugggggucccuggaucacccggucccccuggaccaccaggggucaaaggagaucuuggacucccuggacucccuggagcaccgggaguaguaggauuccccggacagaccggaccacgcggagaaaugggacagccugguccgucgggggaaaggggcuuggccggaccgccaggcagagaaggcauccccgguccacugggacccccugguccgccaggaucggucggaccaccaggcgcuagcggccuuaagggugauaaaggagaccccgguguaggauugccaggcccuagaggcgaaagaggggagccgggaaucaggggcgaggaugggcgaccgggucaagaaggcccuagggggcugaccgguccgccugguucgaggggagaacgcggagagaagggugacguggggucggcaggacuuaagggggauaagggggacuccgcggugauucuggggccaccuggccccaggggagcaaaaggggauaugggcgagagagguccccgaggucuggauggagacaagggaccucgcggagauaacggagaucccggagauaaggggucgaaaggagaaccgggagauaaaggguccgcgggacugccuggacucagggggcuucucgggccucaggggcagccaggugcggcagguaucccaggggaccccggaagcccugguaaggaugggguacccgguauccgaggugaaaaaggggacgugggcuucaugggaccacgagggcugaagggugaaaggggugucaaaggggcgugcggauuggacggggaaaagggggacaagggggaagcggguccgccaggaaggccgggauuggcgggacacaagggugagaugggggagcccggagucccgggucagucaggagccccuggaaaggaaggauugauugguccaaagggagacaggggcuucgauggacaaccaggacccaaaggcgaccaaggagagaaaggagagaggggaacgccugguauuggaggauucccgggucccucgggaaacgauggaagcgcagggccacccggacccccugguagcguggggccucggggacccgaaggccuucaaggucaaaaaggugaaagaggacccccuggugagagaguggugggagcgccuggggugcccggagcucccggagaacggggagaacaaggacgcccuggcccagcggguccucgaggggaaaaaggugaagcggcacucacggaggaugacaucaggggguuugugaggcaggagaugucccaacacugcgcgugucaaggacaguucaucgcuagcgguuccaggccacuucccucguacgccgcagacacggcagggucacaacuccaugccgucccugucuugcgggucagccaugcugaagaagaagaaagaguaccacccgaagacgacgaguacagcgaguauuccgaguauucggucgaagaguaucaagaucccgaagcgccuugggacuccgacgaucccuguucgcuccccuuggacgaaggaucgugcacggcuuauacacuuaggugguaccacagagcggugaccggaucgacagaggcgugccaccccuucgucuacggugguugcggugguaacgcgaacagauuuggaacgcgcgaagcgugugagcgcagauguccgccucgaguggugcagucgcaggggacggguaccgcccaggauugauaagcugccuucugcggggcuugccuucuggccaugcccuucuucucucccuugcaccuguaccucuuggucuuugaauaaagccugaguaggaaggcggccgcucgagcaugcaucuaga

SEQ ID NO: 1627 - RNA, 578 nt, Artificial Sequence
  Description of Artificial Sequence: Synthetic coding sequence
gggaaauaagagagaaaagaagaguaagaagaaauauaagagccaccauguggcuccagucacuuuuguugcuuggaacggucgcaugcuccaucucggcaccagcgcggucccccucgccgagcacgcagccuugggaacaugugaacgcuauccaagaagcgaggagacuucugaaucugucacgagauacagcggccgagaugaacgaaacuguagaggucaucucagagauguuugaccuucaagagcccacaugucuccagacccgccuggaacuguauaagcagggguugcggggaucccucaccaaauugaaaggucccuugaccaugauggccucgcacuacaaacagcacuguccgccgacgccugagacaucgugcgcgacgcagauuaucacuuuugaaagcuucaaggaaaaucucaaggacuuccugcucgugauuccauucgauugcugggagcccgugcaagagugauaagcugccuucugcggggcuugccuucuggccaugcccuucuucucucccuugcaccuguaccucuuggucuuugaauaaagccugaguaggaag

SEQ ID NO: 1628 - RNA, 758 nt, Artificial Sequence
  Description of Artificial Sequence: Synthetic coding sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 1629 - RNA, 4586 nt, Artificial Sequence
  Description of Artificial Sequence: Synthetic coding sequence
gggaaauaagagagaaaagaagaguaagaagaaauauaagagccaccaugcagaggucaccgcucgagaaagcgucaguggugucgaaacucuucuucucauggacgcggccuaucuugcggaaaggguaccgacagcggcuugagcucagcgauaucuaccaaaucccuagcguggacucggcggauaaucugagcgagaagcucgagagagaaugggaccgggaguuggcuuccaaaaagaacccuaagcucauuaacgcgcuccgccggugcuucuucuggcgguuuauguucuacgggauuuuucucuaucucggagaagucacuaaagccguccagccgcuccuuuugggacggaucauugcgucguacgauccugauaacaaagaggaacgcucgaucgccaucuaccucgggaucggguugugccuucuguuuaucguaagaacgcuuuuguugcaccccgccauuuucgggcugcaucacaucggaaugcagaugcgaaucgcgauguucucccuuaucuacaagaagacccuuaaacugucguccagagugcucgauaaaaucucaaucggccaacucgugucgcucuuguccaauaaccuuaacaaguucgaugagggccuugcgcuggcacacuuuguguggaucgcaccacuccaaguggcguugcugaugggccugauuugggaacuguugcaagcgucagcguucuguggucuuggauuccuuauuguccuugcauuguuucaagcggggcugggacgcaugaugaugaaauaccgcgaccaacgggcagggaagaucuccgaaagacuugugaucacgucggagaugaucgagaauauucaguccgugaaggcauauuguugggaagaggccauggagaagaugauugaaaaccucaggcagacagaacucaaacucacaagaaaagcggcauauguccgcuacuucaacucguccgcauucuuuuucagcggcuucuucguaguguuucuuucaguacuuccuuaugcauugaucaaaggaauuauucuccggaagaucuucaccacuaucucguucugcaucgugcuucgcauggccguaacccgacaguuccccugggcaguacaaacgugguacgauagcuugggggcuaucaauaagauccaggauuucuugcaaaagcaagaguauaaaacguuggaauauaacuugacaacuacggaaguggucauggagaaugucacagcauuuugggaagaagguuuuggagagcuguuugagaaagccaaacagaacaacaacaaccgcaaaaccucgaauggugaugacucguuguucuucucgaacuucucguugcucggaacacccguauugaaagacaucaacuucaaaaucgagagaggacagcugcuggcggucgcggggagcacgggggcgggaaaaaccagccuguugauggugauuaugggggagcucgagcccagcgaagggaagauuaaacauagcggucgcaucucguuuugcucgcaguucagcuggauuaugccgggaacuaucaaggaaaacaucauuuuuggaguaucauacgacgaguaccgguaucgaucagucauuaaggcgugucagcucgaggaagauauuucgaaauuugcggagaaagauaacauuguguugggagaaggcgggauuaccuugucgggcggucaacgagcgagaaucagccuggcuagagcggucuauaaggaugcagauuuguacuugcuugacucgccauuugguuaucucgauguguugacggaaaaggagaucuuugaaagcugcguguguaagcuuauggcgaacaagaccaggauccucgucacuuccaagauggagcauuugaagaaggcugacaagauccucauucuucacgaagguagcagcuacuuuuauggaacguucucagagcugcagaaucuccagccugacuuuucauccaaacucauggggugcgauucguuugaucaguucuccgccgaaagaaggaacagcauucugacagaaacacugcaucgcuucagccuugagggugacgcucccgugucguggacggagacaaagaaacagucguuuaagcagacgggggaguucggagagaagcggaagaauucaaucuugaaucccaucaauuccauucggaaguucagcaucgugcagaaaacgccgcugcagaugaaugggaucgaagaagauucagacgaaccccuggagcgccgauugagcuuggugccagauucagagcagggugaggccauuuugcccagaaucagcgucaucucaacggguccgacguugcaggcgagaaggcgccagucggugcucaauuugaugacccacagcguaaaccaaggucagaacauccaucgaaaaacaacugcgucgaccaggaaggugucguuggcgccucaggcaaaucucacggaauuggacaucuauuccagacgccugagccaggagacagggcucgaaauuuccgaggagaucaacgaagaggauuugaaggagugcuuuuucgacgauauggaauccaucccggcagugacgacguggaauacguacuugcgcuacauuaccguccacaaauccuugaucuuuguccucaucuggugucucgucaucuuccuugcggaaguggcggcaucauugguggugcucugguuguugggcaacacaccucuccaagauaaggguaacucgacgcacucccgcaacaacucguaugccguaaucaucacaucaacaucgucguacuacgucuuuuacaucuacguaggcguggccgacacuuugcuggccaugggauuuuuccgcggacugccauuggugcauacgcuuaucacgguauccaaaauucuccaccacaaaaugcuccacucgguccuccaagcgcccaugucgacacugaacacacuuaaggccggggguauccucaauagguucucgaaggacaucgcaauucuugaugacuuguugccccucacgaucuucgauuucauucagcuucucuugaucgugauuggggccauugcggugguagcggugcuucagccguacauuuucgucgccaccguccccguaauugucgcguuuaucaugcucagagcguacuuucuccagacgucgcaacagcuuaagcaauuggagucggaagguagaucacccaucuucacacaucugguaacaucgcucaagggacucuggacccuuagagcguucgggagacagccguauuuugagacacucuuucacaaggcccugaaccuucauacggcgaauugguucuuguacuugucgacgcucagaugguuucagaugcggaucgaaaugaucuucgugauuuucuucaucgccgucacguucaucuccauccucaccacaggggaaggcgagggacgcguagggauuaucuugacacuugcgaugaacaucaugucgacacuucaaugggccgugaauucgagcauugauguagacucacugaugagaucggugucgcgcguguucaaguucaucgacaugcccaccgaggggaagccuacaaagagcaccaaaccguacaagaauggacaguuguccaaagucaugaucauugagaauucgcacgucaagaaggaugauaucuggccgagcggagggcaaaugacugucaaagaccucacagcgaaguacaccgaagggggaaacgcgauuuuggagaauaucuccuucucaaucucaccagggcaacggguaggacuuuugggccggacggggucgggaaaaucaacucugcugucggcuuuucugagguugcucaacaccgagggugaaauccagauugacggcgugucaugggacuccauuacacuucagcaguggagaaaggcguuuggagucaucccccagaaaguguuuaucuucucgggcacuuuccggaagaaccucgaccccuaugagcaguggucagaucaggaaauuuggaaaguggcggaugaagucgggcugcgcucagugaucgaacaguuuccggggaagcuggacuuuguccuugucgauggcggauguguccuuucgcacggucacaaacagcucaugugccuggcgagaucgguccucuccaaagccaaaauccugcuguuggaugagcccucggcgcacuuggaucccguaacguaccagauuaucagaagaacucugaagcaggcguuugccgacugcaccgugauccucugugaacaccgaauugaggcaaugcuggagugccagcaauuccuggucauugaggagaacaaggugcgacaguaugacuccauucagaaacuuuugaacgaacgaucccuuuucagacaagccaucucaccauccgaccgcgugaaacucuuuccucaucggaauucgucgaagugcaagucgaaaccucaaaucgcggcacuuaaggaagaaacggaagaagaaguacaggacacccgacugugaagcgcugccuucugcggggcuugccuucuggccaugcccuucuucucucccuugcaccuguaccucuuggucuuugaauaaagccugaguaggaag

SEQ ID NO: 1630 - RNA, 347 nt, Artificial Sequence
  Description of Artificial Sequence: Synthetic coding sequence
gggaaauaagagagaaaagaagaguaagaagaaauauaagagccaccaugaggauccacuacuugcucuucgcguugcuguuucucuuccuggugcccgucccuggccaugguggaaucauuaacacacuucagaaguauuacugucgggugagagggggacgaugcgccguacuuucaugucucccgaaagaagagcaaaucggaaagugcucgacgagagggcggaaauguugcaggcgcaaaaaguaaugagcugccuucugcggggcuugccuucuggccaugcccuucuucucucccuugcaccuguaccucuuggucuuugaauaaagccugaguaggaag

SEQ ID NO: 1631 - RNA, 347 nt, Artificial Sequence; identical to SEQ ID NO: 1630
  Description of Artificial Sequence: Synthetic coding sequence

SEQ ID NO: 1632 - RNA, 338 nt, Artificial Sequence
  Description of Artificial Sequence: Synthetic coding sequence
gggaaauaagagagaaaagaagaguaagaagaaauauaagagccaccaugcggguccucuacuugcuguucucauuucucuucaucuuucuuaugccccuuccgggaguguuugggggaaucggugaccccgugacgugcuugaaaucgggagcgaucugccacccgguauucugcccaaggcgcuauaagcagauugggacauguggucugcccggcaccaaguguuguaaaaagccuuaaugagcugccuucugcggggcuugccuucuggccaugcccuucuucucucccuugcaccuguaccucuuggucuuugaauaaagccugaguaggaag

SEQ ID NO: 1633 - RNA, 338 nt, Artificial Sequence; identical to SEQ ID NO: 1632
  Description of Artificial Sequence: Synthetic coding sequence

SEQ ID NO: 1634 - RNA, 992 nt, Artificial Sequence
  Description of Artificial Sequence: Synthetic coding sequence
gggaaauaagagagaaaagaagaguaagaagaaauauaagagccaccaugcgagggaugaagcuucucggugcguuguuggcgcucgcagccuugcugcagggagcggugagccucaaaauugccgcuuucaacauccagacauuuggcgagacuaaaaugagcaaugcgacacuuguaucguacaucguacagauucugucgagauacgacauugcgcucgugcaagaagugagagacagccaccugacggcagugggaaaauugcucgauaaucucaaccaggacgcucccgacaccuaccacuacgucguaagcgaacccuuggggcgaaacucguauaaggagcgcuaccuguucguauacaggccggaucaagucuccgcgguggacucauauuacuaugacgaugggugugagccgugcgggaacgacaccuuuaaccgggaaccugcuaucgucagguucuucucgcgcuuuacggaaguccgcgaguuugccaucguacccuugcacgccgcaccaggagaugcgguggccgagaucgaugcccucuaugacgucuaucucgauguccaagagaaguggggucuugaagaugugaugcuuaugggagacuucaaugccggauguucauauguccggcccucacagugguccucgaucaggcuguggacgucacccacauuucaguggcugauuccggacuccgcagacacuacggcgacgcccacccauugcgcguacgaucggaucguaguggcagggaugcuccuuagaggcgcgguggucccggauuccgcucuuccuuucaauuuccaagcggcauacggucuuucagaccaguuggcccaggcgaucucggaucauuauccugucgaggugauguugaagugauaagcugccuucugcggggcuugccuucuggccaugcccuucuucucucccuugcaccuguaccucuuggucuuugaauaaagccugaguaggaag

SEQ ID NO: 1635 - RNA, 6389 nt, Artificial Sequence
  Description of Artificial Sequence: Synthetic coding sequence
gggaaauaagagagaaaagaagaguaagaagaaauauaagagccaccaugcugugcugucucuugguacgggcuucgaaucuuccaucagccaagaaggacaggcgguccgacccuguagcaucgcuuacguucaggggagucaagaagagaacaaaggucauuaaaaacucaguaaaccccguguggaacgagggguucgagugggauuugaaggggaucccucucgaucaggguucagaguugcacguaguagugaaagaccaugaaacgauggggcgaaaccgcuucuugggggaagcgaaggucccccucagagaggucuuggcuacgccgucguugucggccagcuuuaacgccccguugcuggauacgaagaaacagccgacgggagccucacucguguugcaaguaucguauacuccgcuucccggggcggucccccuuuuuccucccccgacaccgcuugagccuagccccacucugcccgaucuggauguggucgcggacacugguggagaagaggacacagaggaccagggguugacuggggacgaggcagagcccuuccucgaucagucgggcgggccuggugcucccacuacaccgcggaaacucccuagccggccucccccgcacuauccagggauuaagagaaaaaggagcgcaccgacaagccgcaaacucuuguccgacaaaccgcaggacuuccaaaucagggugcaggucauugagggacgccagcuccccggagugaauaucaagcccguaguaaaagugaccgcggcaggucaaacaaaaaggacacggauucauaaaggaaauuccccgcucuucaacgagacauuguucuuuaaucucuuugauucaccgggagagcucuucgacgaaccuaucuuuaucacuguggucgauucccgcucacuucggaccgacgcgcuccuuggagaguuuaggauggauguagggacaaucuaucgagaaccgaggcaugcuuaucuuagaaaguggcugcuguugucggaucccgaugacuucuccgccggagcacggggguaucucaagacgagccucugcgucuugggaccgggggaugaagcgccccucgagcgcaaggauccguccgaggacaaagaggacaucgagagcaacuuguugcggccgacuggcguggcccugagaggagcccauuucugucucaaggucuuuagggccgaggaucucccacaaauggaugacgccguaauggauaacgugaagcagauuuucgguuuugaauccaauaagaagaaucuugucgauccguuugucgaggucucguuugccggaaagaugcuuugcagcaagauccuugaaaagacagcaaacccccaguggaaucaaaacaucacgcugccagcuauguuuccguccaugugugagaagaugagaauucgcaucaucgacugggaucggcuuacgcacaacgacaucgucgccaccaccuaucugucgaugucgaagaucucagcaccagggggugaaauugaggaagagccugccggugcagugaaaccgucaaaggcgucggauuuggaugacuaucuggguuuucuucccacauuuggaccuugcuacaucaaccuuuacggcucgccucgggaauucaccggauuccccgaccccuauacggaacugaauacagggaagggugaggggguggcauacagagguaggcuucuguugucgcucgagacaaagcuuguagagcacucggagcagaaggucgaggaccugccggcagacgauauucugcgaguggagaaauauuugcggcggcggaaguauucgcucuuugcggcauucuacagcgcuacuaugcugcaagaugucgacgacgcgauccaguucgaaguaucgaucggaaauuaugguaauaaguucgauaugacgugucuuccacucgcuucaaccacgcaguauucgagagcgguguucgauggaugccacuacuacuaucugccuuggggaaaugucaaacccgucgugguccucucguccuauugggaagauauuucacaccgcaucgagacgcagaaccagcugcugggaaucgccgauagguuggaagccggguuggagcaggugcaucucgcgcucaaggcgcagugcagcacugaggacgucgacucgcugguagcucaacuuacagacgagcugauugcgggguguagccagccccugggugauauccacgagacacccucggcgacucaccucgaccaguauuuguaccagcuccgcacccaccaccugucgcaaauuacagaggcugcccuggcgcugaagcugggacacuccgaacugcccgcagcguuggagcaggcggaagauuggcuccuuagguugagggcgcucgccgaggagccucagaauagccucccugauauugucaucuggauguugcagggggauaaacgaguggccuaccagagggucccggcgcaucaaguccuuuuuucaagacggggagccaacuacugugggaaaaacugcggaaagcugcaaaccauuuuucucaaguaccccauggagaaggugcccggugcacgcaugcccguccagauccgcgucaaacugugguuugggcucucggucgacgagaaggaguuuaaucaauuugcagagggcaaacucucgguguuugcggagacuuaugagaacgaaacgaaguuggcauugguggggaauuggggaacuacgggacuuacguacccgaaguuuagcgaugugacagggaagauuaaacuucccaaagacuccuuuagaccgucagcaggguggacaugggcgggugacugguucgugugccccgagaaaaccuuguugcaugacauggacgcuggucaucucucauucguagaggaaguguucgaaaaccaaaccagauugccggguggacaauggaucuauaugucagauaacuacacagaugucaauggggaaaaagugcuucccaaagaugacauugagugcccuuugggguggaagugggaggacgaagaguggagcacggaccucaauagggcgguagacgaacaggggugggaauauucaauuacgaucccacccgagaggaagccaaagcacugggugccugccgagaagauguauuacacgcaccgaaggagaaggugggucagauugcgacggcgcgacuugagccagauggaggcgcuuaaaagacaccgacaggcggaagccgaaggagaagguugggaguacgccucacucuucggauggaaauuucaucuggaguauagaaagacagaugccuuuagacgcaggcgguggaggagaaggauggagccuuuggagaaaacuggucccgcugccgucuuugcgcuggaaggcgcacuuggcggggucauggacgauaaguccgaggacuccaugagcgucuccacccuguccuucggcgucaauaggccaacgaucucguguaucuucgauuaugggaaucgguaccaucuccgaugcuacauguaccaggcucgcgaucuugcggcaauggacaaagacagcuuuucggauccuuacgcgaucgucucguuuuugcaucagucgcagaaaaccgucguagugaagaauacucucaacccgacgugggaccagacauugaucuuuuacgagaucgagaucuuuggggagccugcgacgguggccgagcagccgcccucgaucguagucgaauuguaugaccaugauacauauggagcagaugaguuuauggggcggugcaucugucagcccucacuggagagaaugccgagacucgcaugguuuccguugaccagaggaucgcaacccagcggugaacuccucgccucguuugaauugauucagagagagaagccugcgauccaucauauccccggcuucgagguccaagaaacgucgcgcauuuuggacgaaagcgaagauaccgaucucccguacccacccccgcaacgagaggcaaacaucuacaugguaccgcagaacaucaagccagcccuucaacgcacggccaucgaaauccucgcauggggguugcgaaauaugaagucguaucaguuggccaacauuuccucgccuucgcucguggucgaauguggcgggcaaacgguccaaucgugcgugauccgcaaccuccgcaagaaucccaauuucgauaucugcacacucuucauggaagucauguugccgcgcgaggagcuguacuguccgccgauuaccgucaaagugaucgacaaccgccaguucggccgccgcccggugguaggacagugcacaauccgcucgcuggagagcuuuuugugcgaccccuauagcgcggagucccccucgccgcagggcgguccugaugacgucucauugcuuagccccggagaggacgugcugaucgacauugacgauaaggagccgcucaucccaauccaagaagaagaguucaucgauugguggucaaaauuuuucgcauccauuggugagagggagaagugcggguccuaucuugaaaaagacuucgacacucucaaaguauacgacacucagcuggagaacgucgaggccuuugaaggacucucggacuucuguaauacauucaaacucuacagaggaaaaacgcaggaagagacagaggaccccucggucauuggcgaguuuaagggucucuucaagaucuacccgcuuccagaggauccugccaucccgaugccaccucgccaguuccaccagcucgccgcgcaagggccccaggagugccuuguccgaaucuacaucguaagagcguucggacuucagcccaaggaucccaauggaaaaugugacccguauaucaagauuucgaucggcaaaaagucgguaucagaucaggacaacuauauuccgugcacacuugagcccguauucggaaagauguucgagcucacgugcacgcugccgcucgaaaaggaccucaagaucacacuuuaugauuaugaccuucucucgaaggaugaaaagauuggcgaaacggucguggaccuugaaaauagacuccuuagcaaguucggagcaaggugcggacugccccagacguauugcgugucggggcccaaccaguggcgggaucagcuucggccaucacagcugcugcaccucuuuugccagcagcauagggugaaagccccaguguaucggacagauagagucauguuucaggauaaagaguacucaaucgaggagauugaagcagguagaauccccaacccgcaccucggacccguggaagaacggcucgcguugcacguccuucagcagcaggguuugguacccgaacacguagagucgcgcccauuguacucgcccuugcaaccagauauugaacagggaaaguugcagauguggguagaccucuuccccaaagcgcucgguagacccggaccaccuuuuaacauuaccccacgcagggcgagacgauucuuuuugcgguguauuaucuggaacacccgcgaugucauccucgaugaccucucgcucaccggagaaaagaugucggauaucuacguaaagggauggaugaucggauuugaggaacacaagcagaaaacagacgugcauuaccgaucacucgggggagaaggaaacuuuaacuggcgcuuuaucuuucccuucgacuaucuucccgccgaacaagucuguacaauugcgaaaaaggacgcauucuggcgauuggauaaaacggaauccaaaauucccgcacgcguaguauuucagaucugggacaaugauaaguucucauuugacgacuuucuggggucccugcaguuggaucugaacaggaugccgaagccugccaagacggccaaaaaguguucacucgaucaacuggacgacgccuuccacccggagugguuuguaucgcuuuuugagcagaaaacagucaaagguugguggccuuguguggcggaagagggggaaaagaaaauucucgcgggcaagcucgagaugacgcuugagaucgucgccgaguccgagcacgaggagagaccagcuggacaaggccgggaugagcccaacaugaauccgaagcuggaggacccgcgacgcccugauaccagcuuccucugguuuacgucgcccuauaagacuaugaaauucauccucuggaggagauucagaugggcgaucaucuuguucaucauccuuuucaucuugcuucuguuuuuggcgaucuuuaucuacgccuucccgaacuacgcagccaugaagcuugucaagcccuuuucaugaagcgcugccuucugcggggcuugccuucuggccaugcccuucuucucucccuugcaccuguaccucuuggucuuugaauaaagccugaguaggaag

SEQ ID NO: 1636 - RNA, 1313 nt, Artificial Sequence
  Description of Artificial Sequence: Synthetic coding sequence
gggaaauaagagagaaaagaagaguaagaagaaauauaagagccaccaugggguacccugagguggagcgcagggaacuucugccugcagccgcaccgcgggagcgcggaagccaggggugcgggugugguggcgcaccagccagagccggggaagggaauucauguuugcuuuuucucgguuucuucgguuugucccuggcguugcaccuucucacccuguguugcuaccucgaacugagaucagaguugcggcgagagcggggagcugagucccggcuuggcgguagcggaacucccggaacgucggggacgcucagcucacuggguggacuggaucccgacagcccuauuaccucacacuugggucagccuucgccgaaacagcaaccccucgaacccggagaggcagcacuccauucggauucgcaagacggacaccagauggcgcucuugaacuucuucuuucccgacgaaaagccuuauagcgaagaagagucccgaagggugcgccggaacaagcggucgaagucaaaugagggugcggacggacccgugaagaacaaaaagaagggaaagaaagcugggcccccgggaccgaaugggccaccaggaccgccaggucccccuggaccacaagguccgccuggaaucccgggaauuccggguauccccggcacaacagucauggggccacccggaccaccgggaccgccugggccgcagggacccccugggcuccaggggccuucgggugcugcggauaaggcgggaacaagggagaaucagcccgcagucguccacuugcagggacagggaucggcgauccaagugaaaaaugacuuguccggugggguccuuaacgacuggucaagaaucacuaugaauccaaaggucuuuaaacuucacccuagaucaggugaacucgaaguguuggucgauggaacguauuucaucuacagccagguauacuauaucaacuuuaccgacuuugccucguaugaggucguaguagaugagaagccuuuucugcaguguacucggucaauugagacagggaaaaccaauuacaacacgugcuacacugcuggagugugccuguugaaggccagacagaagaucgcggugaaaaugguacaugcggauaucucgauuaacaugucaaaacauacgacauucuucggggcgauuagacugggcgaagcucccgcauccugauaagcugccuucugcggggcuugccuucuggccaugcccuucuucucucccuugcaccuguaccucuuggucuuugaauaaagccugaguaggaag

SEQ ID NO: 1637 - RNA, 3572 nt, Artificial Sequence
  Description of Artificial Sequence: Synthetic coding sequence
gggaaauaagagagaaaagaagaguaagaagaaauauaagagccaccauguugguacuuagaugccgacucggaacgucguuuccgaagcuugauaaccugguccccaaagggaagaugaagauuuugcucguguuucucggcuugcuuggaaacuccguagccaugcccaugcacaugccgagaaugcccggauuuucgucaaaaucggaagagaugaugcgguacaaccaguucaacuuuaugaaugggccgcauauggcgcacuugggccccuuuuucgggaauggacugccucagcaguucccucaguaucaaaugcccauguggccccagcccccaccuaauacauggcacccgcggaagucauccgcgccuaagagacacaauaagacggaccagacccaagaaacgcagaagccgaaucagacccagagcaagaaaccaccgcagaagcgaccccucaagcagccaucccauaaucagccgcaaccagaagaagaggcucagccaccacaggcauuuccgcccuuuggcaaugggcucuuuccguaucaacaaccgccguggcagaucccucaacggcuuccaccaccgggauaugguagaccacccaucucaaacgaagaggguggaaaccccuauuucggcuacuucggguaccauggguuuggcggaaggccaccguauuacucggaagaaauguucgagcaggacuuugaaaagcccaaagaagaggacccaccuaaggccgaauccccugguacugagcccacagcgaacucaacggugacggagacaaauucaacucaaccuaacccgaaagggagccagggcggcaacgauacaucgccgacggguaauagcacgccagggcuuaacacugguaauaacccaccggcgcaaaacgguaucggaccucuucccgcggucaacgcgucgggacaaggugguccggggucgcagauuccauggaggcccagccagccaaauaucagggagaaccacccguacccgaacauucgcaacuuucccucgggacggcagugguacuucaccggaacagugaugggacaucgccaaaauaggccauuuuaccgcaaucagcaggugcagagaggaccacgcuggaacuucuucgcgugggagcgaaaacaggucgcgaggccgggaaacccuguauaccacaaagcauacccacccacuucgcggggaaacuaccccaacuacgccgggaaccccgcuaacuugcgccgaaagccccagggucccaacaagcacccgguggggacuaccguagcgccgcucgggccgaagccugguccgguggugcggaacgagaaaauccagaauccgaaagagaagccccuuggacccaaagagcagaucaucgugcccacuaagaaccccacaucgcccuggcgcaacucccaacaguaugaggugaauaagucaaacuacaagcugccccauucagaaggcuacaugccggugccgaacuucaauagcguagaccagcacgagaacucguauuacccucggggagacucccggaaggucccaaauucggacggacagacgcaaagccaaaaucugcccaagggaauuguccucgguucgcgaaggaugccguacgaguccgagacaaaccagucggagcuuaaacacucauccuaucaacccgccgucuaccccgaagagauuccgucaccagcgaaagaacacuucccagcagggagaaacacuugggaccaccaagaaauuucaccacccuucaaagaggaucccggacgccaggaagagcaucuuccgcacccgagccauggaucgcgagggucgguguucuacccugaguacaacccguaugacccucgggagaacagccccuaucuuagggguaacacgugggacgagcgggacgauagcccaaacacaaugggacagaaagagucgccguuguaucccaucaacacaccagaccagaaagagaucgugccguacaacgaagaagaucccgucgacccgacgggggaugaaguauuucccgggcagaacagguggggcgaagaguugucguuuaaagggggaccuaccgugcggcacuaugagggagagcaguacacaucgaaucagccaaaagaguaucuccccuauucgcucgauaauccgucgaaaccgagggaagauuucuauuacucagaguucuaucccuggucgcccgacgaaaacuuuccaucauauaacacggcgagcaccaugccaccgcccauugagagcaggggguacuaugugaacaacgcagcggguccggaagaaagcacucucuuccccucacgcaauagcugggaucauagaauucaggcccagggccagcgggaacggcgaccuuacuuuaacagaaacaucugggaccaggcgacgcauuugcaaaaggcucccgcucggccacccgaucagaaggggaaccagcccuacuacucgaacacgccagcagggcuccagaagaauccuaucuggcacgagggggaaaacuugaauuauggaaugcagaucacacggaugaauucgcccgaacgggaacacucguccuuccccaacuuuaucccaccuucguauccgucggggcagaaagaggcacacuuguuucaucuuagccagcgcggaucgugcugcgcgggaucguccacgggaccgaaggacaauccgcucgcccuucaagacuauaccccuucguacggguuggcaccgggagaaaaccaggacacaucaccccuguacacugaugguucccacacuaaacagacucgcgacauuaucagccccacaucaauucucccuggccagagaaauagcucagaaaagagagagagccagaaccccuuuagggaugaugugucgacgcuucgccgaaauacccccuguucgaucaagaaccagcuuggucaaaaagagaucaugccguuccccgaggccucaagccugcagucaaagaauacacccugucugaagaaugaccucgggggugacgggaauaacauucuggaacagguauuugaggauaaucagcucaacgaaaggacgguggaucucacucccgagcaacuggucauugguacgccggacgaggggagcaaucccgaagguauccaaucgcagguacaggaaaaugagucagagcggcagcagcagaggccgucgaauaucuugcaccuuccauguuucggaucaaaacuggcaaaacaucauucaucaacaacugguacuccgucgucagacgguaggcagucccccuucgauggagacuccaucacgccuacggagaaucccaacacgcuggucgagcuggcgacugaagagcaguucaaguccaucaauguggauccgcuugaugcggaugagcacuccccguucgaauuucuccagcgggguacuaauguacaagaucagguccaagauugccuucucuugcaagccugauaagcugccuucugcggggcuugccuucuggccaugcccuucuucucucccuugcaccuguaccucuuggucuuugaauaaagccugaguaggaag

SEQ ID NO: 1638 - RNA, 725 nt, Artificial Sequence
  Description of Artificial Sequence: Synthetic coding sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 1639 - RNA, 1712 nt, Artificial Sequence
  Description of Artificial Sequence: Synthetic coding sequence
gggaaauaagagagaaaagaagaguaagaagaaauauaagagccaccauggcugccgugguggcggcaacccgcugguggcagcugcuccuugugcucucagcagcaggaaugggggcgucgggggcuccccagccgcccaacauccugcucuugcucauggacgauauggguuggggugaccuugggguauacggagagccgucgagggaaacucccaacuuggacaggauggcggcagaaggucugcucuuuccgaacuuuuacucagcuaacccucuuugcucaccgucgcgagcggcgcuucugacugggagacuccccaucagaaauggguucuauacaacgaacgcccacgcucgcaaugcauacacaccgcaagagaucguggguggcauuccugauucggagcaguuguugccagaacuccuuaagaaggcgggauaugucucgaaaaucgucggaaaguggcaucucggccaccgaccccaguuccauccucuuaaacauggcuuugaugagugguuugggucgcccaauugccacuucggcccguaugacaauaaggccaggccaaacaucccggucuacagagauugggaaaugguagggcgguauuaugaagaguucccgaucaaucuuaaaacaggggaggcgaaucucacgcagaucuaccuucaagaggcgcuggacuucaucaaaagacaagcacggcaccaucccuuuuucuuguacugggccguagaugcuacacaugcgcccguguacgccuccaagccguuuuuggggacgagccagcggggacgcuacggggacgcggugcgcgagaucgacgauucaauuggaaagauucuugaacuuuugcaagaucuccacgucgcagauaauacuuucguauucuuuaccuccgacaacggagcagcgcugauuucagcaccggagcagggagggucgaauggucccuucuugugugggaaacagacgaccuuugagggaggaaugcgggagccugcguuggccugguggccugggcacguaacggcgggucagguaucacaucagcuuggaagcauuauggaucucuuuaccacaucgcuggcacucgccggacucacucccccguccgauagggcaaucgauggguugaaccuuuugccaacgcuccuucaaggucgacugauggaucgccccaucuucuauuacaggggugacacguugauggcggcgacauuggggcagcacaaggcacauuuuuggacauggacaaacucgugggaaaacuuccggcagggcaucgacuuuugucccggacaaaaugugagcggaguaacgacacacaaccuugaggaccauacgaagcucccucuuaucuuucaucuuggucgggacccgggugaaagguuuccccugucguucgcuucagcggaguaucaggaggcacugagccggauuacuuccgucguccagcaacaccaggaagcccucgugccagcucagccccaguugaacguauguaacugggcggugaugaauugggcaccgccugguugugagaaguuggggaaaugccugacgcccccugaauccauuccgaaaaagugcuuguggagccacuaaugagcugccuucugcggggcuugccuucuggccaugcccuucuucucucccuugcaccuguaccucuuggucuuugaauaaagccugaguaggaag

SEQ ID NO: 1640 - RNA, 1433 nt, Artificial Sequence
  Description of Artificial Sequence: Synthetic coding sequence
gggaaauaagagagaaaagaagaguaagaagaaauauaagagccaccaugcagcuucggaauccagaacuccauuuggggugcgcgcucgcacugcgguuucucgcgcuggugucaugggacauuccgggagcgcgagcccuggacaacggguuggcgagaacuccgacaauggguuggcuccauugggagcgguuuaugugcaaccuugauugucaggaggagcccgauucguguaucuccgaaaaacucuucauggaaauggcggagcuuauggugagcgaggguuggaaggacgcaggguacgaguauuugugcaucgacgauugcuggauggccccacagagggacuccgaaggacgccuccaagcggacccgcagcgguucccgcacgguauccggcagcucgcuaacuacguacacagcaaagggcuuaagcuggguaucuacgcggacguagggaacaagacgugugcaggguuccccggcucauucggauauuacgauauugacgcccagacguuugcggacuggggcgucgaucuucugaaguuugacggaugcuacugcgacagccucgaaaaucuugcugauggauacaaacacaugucccuggcacugaacaggacgggucgcuccaucguguauucgugugaauggcccuuguauauguggccauuucagaagcccaacuacacggaaaucagacaguauuguaaccacuggaggaauuucgcggacauugaugauagcuggaagucgaucaaaucaauuuuggauuggacaucguucaaccaggagcgcaucguggacgucgcgggucccggaggguggaaugacccggauauguugguaauuggaaacuuuggccuuucguggaaucagcaagugacccagauggccuugugggcgauuauggcagcgcccuuguucaugucgaaugauuugagacauauuucgccgcaggccaaggcguugcuucaagauaaggacgugaucgccaucaaucaggaccccuugggaaaacagggauaccaacuccgccaaggagauaacuucgaggucugggaaaggccccuuucgggacuugcuugggccguggcgaugaucaacagacaagagauuggggguccucgguccuauacuaucgccguggcaucacuugguaaaggagucgcauguaaucccgcgugcuucaucacucagcuccuuccugucaagcgaaaauugggguuuuaugaguggaccagccgccugcggucgcacaucaauccaacagggacugugcucuugcagcucgaaaacacaaugcagaugucccucaaagauuugcuguaaugagcugccuucugcggggcuugccuucuggccaugcccuucuucucucccuugcaccuguaccucuuggucuuugaauaaagccugaguaggaag

SEQ ID NO: 1641 - RNA, 272 nt, Artificial Sequence
  Description of Artificial Sequence: Synthetic coding sequence
gggaaauaagagagaaaagaagaguaagaagaaauauaagagccaccauggggguccggcaucccccaugcucccacagacugcuggcuguaugugcacucgugucgcucgcgacagccgcgcuuuugccgcagaacucaaagauccccggaccuacguucuuggacccgcacugauaagcugccuucugcggggcuugccuucuggccaugcccuucuucucucccuugcaccuguaccucuuggucuuugaauaaagccugaguaggaag

SEQ ID NO: 1642 - RNA, 275 nt, Artificial Sequence
  Description of Artificial Sequence: Synthetic coding sequence
gggaaauaagagagaaaagaagaguaagaagaaauauaagagccaccaugggaguacggcauccaccuugcucgcacagauugcucgcggucugugccuuggugucacuggcuaccgcggcacuucucgccaacacgccgugugggcccuacacacacgacugccccgugaagaggugauaagcugccuucugcggggcuugccuucuggccaugcccuucuucucucccuugcaccuguaccucuuggucuuugaauaaagccugaguaggaag

SEQ ID NO: 1643 - RNA, 779 nt, Artificial Sequence
  Description of Artificial Sequence: Synthetic coding sequence
gggaaauaagagagaaaagaagaguaagaagaaauauaagagccaccaugaagcugugggacguggucgccgugugccucgucuuguugcauaccgcgucggcauucccccucccagcggggaagaggccaccggaggcaccggcugaagaucggucccugggccgacgaagagcccccuucgcccucucgucggacuccaacaugcccgaggauuacccugaccaguucgacgacgugauggacuuuauccaggcgacgaucaaaagacucaagagaagcccggauaaacaaauggcggugcuuccucgccgggagcggaauaggcaggccgcagccgcuaacccggagaacucacgcggaaaagggaggaggggacagcgcggaaagaaccgcgggugcgucuugacugcgauccacuugaacgugacagaucugggacuuggguacgaaacgaaagaggaacugaucuuccgguauuguuccgguagcugcgacgcagccgaaacaacguacgacaagauccuuaagaaucucagccgcaauaggcggcuuguaucagacaaaguaggacaggcguguugcagacccauugcguuugaugaugacuugucguuucuggaugauaaucuuguauaucacauuuugcgaaagcauucagcgaaaagaugugguugcauuuaaugagcugccuucugcggggcuugccuucuggccaugcccuucuucucucccuugcaccuguaccucuuggucuuugaauaaagccugaguaggaag

SEQ ID NO: 1644 - RNA, 311 nt, Artificial Sequence
  Description of Artificial Sequence: Synthetic coding sequence
gggaaauaagagagaaaagaagaguaagaagaaauauaagagccaccaugccgucaucagugucgugggggauucuucuguuggcuggacuuuguugccucguccccguaagccuggcgcacgccgaggguacguuuacauccgacgugucgucguaccucgaaggccaggcggcaaaggaguucaucgccugguuggucaggggacgggggugauaagcugccuucugcggggcuugccuucuggccaugcccuucuucucucccuugcaccuguaccucuuggucuuugaauaaagccugaguaggaag

SEQ ID NO: 1645 - RNA, 3002 nt, Artificial Sequence
  Description of Artificial Sequence: Synthetic coding sequence
gggaaauaagagagaaaagaagaguaagaagaaauauaagagccaccaugggggugcggcacccgccuuguucgcaucggcuccucgcugugugugcauuggugucgcuggcgacagcggcgcuccuuggucacauuuuguugcacgacuuucuccuggugcccagagaguuguccggaucgucccccguguuggaggaaacucaucccgcacaccagcagggggccucgcgcccugggccacgcgacgcccaagcccaccccgguagaccaagggcaguacccacacagugugaugugccaccaaacucgagauucgauugugcgccggacaaagcuauuacccaagaacagugcgaagcgagagggugcuguuacauccccgcaaaacaaggacuccagggugcucagaugggacagcccuggugcuucuuuccucccucguauccaagcuauaaguuggaaaaucuguccucaucggaaaugggauauacagcaacacugacaaggacgacuccgacauucuucccgaaggacauucuuacauugagguuggacgucaugauggaaacggaaaaccggcuccacuucacgaucaaggacccggcgaaccgcagauacgaggucccacucgagacaccccaugugcacagcagggcucccucgccguuguauucggucgaauuuucggaagagcccuucggagugaucguccggaggcagcuggaugguagggugcucuugaauacgaccgucgcaccguuguucuuugcggaucaguuucuccaacuuucaacuucguugccgucgcaguacaucacgggacucgcagagcaucucucaccgcucaugcugagcacuucguggacgaggaucacgcuguggaacagagacuuggcgccaacgccuggggcgaaccuuuacgggagccacccuuucuaucuugcgcucgaggaugggggaucggcacacggggucuuucugcucaacucaaacgcuauggacgucgucuugcagccgucgccggcucugucauggcggagcacgggugguauucuggacguguacaucuuccucggcccugaaccaaagucgguggugcagcaguaccuugacgucgucggguacccauucaugcccccguauuggggacuggguuuucaucucugccgcuggggguacuccucgaccgcuaucacccgccaagugguggagaacaugacgcgggcacauuuccccuuggaugugcaauggaaugaccuugacuacauggauucaaggagggauuucaccuucaacaaagacggguuucgggacuuccccgcgauggugcaagaacugcaccagggaggaagaagauacaugaugaucguagaucccgcgaucagcuccuccggaccggcaggaucguacagacccuaugacgaaggcuugcgacgcggaguguucaucaccaacgaaacagggcagccucucauugggaagguguggcccgguagcacugccuuuccugacuucaccaauccgacugccuuggcguggugggaagauaugguggcggaguuccaugaccaggugcccuuugaugguauguggaucgauaugaacgagcccucaaauuucauccggggaucggaagauggcugcccaaacaacgaacucgaaaacccgccuuacguaccaggggucguaggaggaacgcuccaggccgcgacaaucugcgcgucgucgcaccaauuccugucaacccacuacaauuugcauaaucucuauggacugacggaggccauugcaucacaucgagcuuuggugaaggcgagaggaacacggccguuugugaucucgcgcuccacguucgcgggacacgggagguacgcagggcacuggacgggagaugucuggagcagcugggaacaauuggcgucgucgguaccggaaauucugcaguucaaccucuugggagucccucugguaggugccgacgucuguggauuucucgggaacaccuccgaggaacugugcguccgauggacgcaguugggagcguuuuacccguucaugcgaaaccacaacucacuguugucacucccucaagagccauauucguucucggagccggcacaacaagcgaugcgcaaagcgcucacacuucgcuacgcccuuuugccgcaucuguacacccuuuuucaccaggcgcacguagccggggaaacuguggcgaggcccuuguuccucgaauuuccgaaggacucaucgacuuggacagucgaucaccaacuuuuguggggagaggcguuguugauuacaccggugcugcaggccggaaaagccgagguaacaggguauuuuccuuuggguacgugguacgaccuccagacgguccccguggaggcgcuugggucgcuuccuccacccccagcagccccucgcgagcccgcgauccauucggagggacaaugggugacucuucccgcuccgcuugacacaauuaacgugcaucuuagagccggauauaucauuccguugcagggaccgggccucacaacaacggagucgcgccagcagccgauggcacucgcuguagcguugacuaaagggggagaagcucggggagagcucuuuugggaugacggcgagagccucgaaguacuugagcgcggugccuauacacaagucauuuuucucgcacgcaauaacacaaucgugaacgagcucguaagagucacaagcgaaggagccgggcuucaacuccagaagguaacagucuugggcguagccaccgcuccccagcagguccugucaaacggaguaccggucagcaauuucacguacucgccggacacgaagguguuggauauuugcgucagccugcuuaugggagaacaguuucuuguaagcuggugcugaagcgcugccuucugcggggcuugccuucuggccaugcccuucuucucucccuugcaccuguaccucuuggucuuugaauaaagccugaguaggaag

SEQ ID NO: 1646 - RNA, 1754 nt, Artificial Sequence
  Description of Artificial Sequence: Synthetic coding sequence
gggaaauaagagagaaaagaagaguaagaagaaauauaagagccaccauggaguucucaucccccucgcgggaggaauguccuaagccguugucccgggugucgauuauggcagggagccugaccggauuguuguugcugcaagcggugucgugggccucgggcgcacgacccugcauccccaaguccuuuggguacagcucaguggucugugugugcaacgcgaccuauugugacuccuuugaucccccgacuuuuccggcccuggguacauucucaagauaugagucaaccagaagcggucgccgcauggaacuuucaauggggcccauucaggccaaucacacugggacuggucugcucuugacucuucagccugagcagaaguuccagaaggucaaggguuucggcggugcgaugacagacgcggcugcauugaauauucucgcgcugagcccgccugcgcagaaccugcuucucaagucguacuucucggaggaagguaucggguauaacauuauccgaguaccaauggcgucaugcgauuuuucgauucgcaccuacacguacgcugacacgccugacgauuuccaguugcacaacuucucgcugccagaggaggacacgaaacugaaaauuccccucauccauagagcacugcagcucgcacaacggcccgucucccuucuugcgagcccguggacaucacccaccugguugaaaacgaacggcgcagugaacgggaaaggaagccuuaaggggcagccuggugauaucuaccaccagacaugggcacgauacuuuguaaaguucuuggacgcguacgcagagcacaaacuucaguucugggcggucacugccgaaaaugagcccucggcgggacuucugucgggauauccguuucagugcuugggauucacgccggagcaccagagggauuucaucgcucgggauuugggucccacacuggcgaauagcacacaccauaacguacggcuuuugaugcucgacgaucagcgacugcugcucccucacugggccaaagugguacugaccgaccccgaggccgccaaauaugugcauggaauugccgugcacugguaucucgacuuuuuggcaccggcgaaagcgacuuugggcgaaacgcaucgccucuucccgaauacgauguuguucgccucggaagcgugugugggaucgaaguuuugggaacaauccgucagguuggggagcugggaucgggggaugcaauacucgcauucaaucaucaccaaucuuuuguaucaugugguaggauggacggacuggaaucuggcgcuuaacccggaaggaggaccuaauugggugaggaauuucguagacucgccgaucaucgucgacaucacgaaggacacguuuuacaaacagccgauguuuuaccaucuuggacacuuuuccaaguuuaucccggaagggagccagagggucggacucguggccucccaaaagaacgaccucgaugccgucgcgcugaugcacccagauggguccgcugucguggucgugcuuaacagaucgucaaaagaugugccccucacuaucaaagaucccgcgguaggcuucuuggaaacaaucucgccaggauacucaauucauacauaucuguggcgcaggcagugauaagcugccuucugcggggcuugccuucuggccaugcccuucuucucucccuugcaccuguaccucuuggucuuugaauaaagccugaguaggaag

SEQ ID NO: 1647 - RNA, 494 nt, Artificial Sequence
  Description of Artificial Sequence: Synthetic coding sequence
gggaaauaagagagaaaagaagaguaagaagaaauauaagagccaccauggacuacuauaggaaguacgcugcaaucuuucucguaacacuuucagucuuucuccaugugcugcauucggccccugaugugcaagacuguccagaaugcacgcugcaagagaacccguucuucagccagcccggagcgcccauuuugcaguguaugggguguugcuuuucacgggccuauccgacgccccuuagaucgaagaaaaccauguuggugcagaagaacguaaccucggaguccacuuguugcguggcgaaaucguacaaucgcguaacagucaugggcgguuucaaggucgaaaaucacacagcgugccacugcagcacguguuacuaucacaaauccugauaagcugccuucugcggggcuugccuucuggccaugcccuucuucucucccuugcaccuguaccucuuggucuuugaauaaagccugaguaggaag

SEQ ID NO: 1648 - RNA, 797 nt, Artificial Sequence
  Description of Artificial Sequence: Synthetic coding sequence
gggaaauaagagagaaaagaagaguaagaagaaauauaagagccaccauggccacugggucgaggaccagccuguuguuggccuuugggcugcuuugucugccauggcuccaagagggauccgcauucccgacaauuccccucucaagacuguuugauaacgcuaugcuccgagcccaccggcugcaccagcuggcguucgauacauaccaagaauucgaggaagcauacauccccaaagagcagaaguauucguuccuucaaaauccucagacaucgcuuuguuucucggagucaauuccgacgcccagcaauagggaagaaacgcagcagaagucgaaccuugaguuguugcggauuagcuugcuccugauccagucauggcucgaaccggugcaguucuugcgcucgguguuugcgaacucccugguauauggugcguccgauucaaaugucuacgacuugcucaaggaucuugaagaggggauccaaacucucauggguaggcuugaggacggcucgccucgcacgggacagaucuuuaagcagacguauucgaaauuugacaccaauucacauaacgacgacgcguugcucaaaaacuauggauugcucuacugcuuucggaaggacauggauaaaguggagacauucuugagaaucguccagugcagauccguagagggaucaugcgguuuuugauaagcugccuucugcggggcuugccuucuggccaugcccuucuucucucccuugcaccuguaccucuuggucuuugaauaaagccugaguaggaag

SEQ ID NO: 1649 - RNA, 896 nt, Artificial Sequence
  Description of Artificial Sequence: Synthetic coding sequence
gggaaauaagagagaaaagaagaguaagaagaaauauaagagccaccauggaaaaagggcccguccgagcacccgcggagaagccgagaggugcacggugcagcaauggcuucccggagcgggacccaccucggccaggacccagcagaccggcggagaaaccgccuaggcccgaggccaagucagcgcaacccgcggacggauggaagggagagcgcccucgauccgaagaagauaaugagcugaaccuuccuaaucuugcugcagcguauuccucaauccucucgucgcugggugaaaacccccagcgccagggacuguugaaaacgccguggagagccgcgucagcaaugcaguuuuucacgaaaggguaccaggaaaccauuucggacgugcucaacgaugccaucuuugacgaagaucacgaugagaugguaauugugaaagacauugacauguuuuccaugugugaacaccaucuggucccguucgucgguaaagugcauaucggguauuugccgaacaagcaaguguugggauugucgaagcuugcgaggaucguagagaucuacucacggcgacugcaggugcaggagagacucacuaaacagauugcggucgccaucacggaagccuugcggccagcgggggugggggugguagucgaggcuacacacaugugcauggucaugcgcggagugcaaaagaugaauuccaagacagucaccucgacgauguugggcguauucagggaagaucccaagacucgcgaggaguuucuuacacucaucagaucaugauaagcugccuucugcggggcuugccuucuggccaugcccuucuucucucccuugcaccuguaccucuuggucuuugaauaaagccugaguaggaag

SEQ ID NO: 1650 - RNA, 800 nt, Artificial Sequence
  Description of Artificial Sequence: Synthetic coding sequence
gggaaauaagagagaaaagaagaguaagaagaaauauaagagccaccauggcaacacggucaccaggcguggucaucagcgacgacgagcccgguuaugaucuugaucuuuucuguauccccaaucacuaugcggaagauuuggagagaguguuuaucccucacggauugaucauggauagaaccgaaagacuugcucgcgaugucaugaaggaaauggguggacaucacaucguggcgcucugcguacucaagggcggguauaaguucuuugcagacuugcuugauuacaucaaagcccugaaccgcaacucggauagguccauuccgaugacuguagacuuuauccgccucaagucguacuguaacgaccaaagcacaggggacauuaaagucaucgggggugacgaccugucaacgcugacuggaaagaauguacucaucguggaggacaucauugauacgggaaagacgaugcagacccugcucucauugguccggcaguacaauccuaaaauggugaaaguagccucccugcuugucaagaggacgccgcgaucggugggguacaaacccgauuuugucggguucgagauucccgacaaguucguagugggauaugcgcucgacuacaaugaguauuuccgagauuugaaccaugugugcgucauuucggaaacaggaaaagccaaguacaaagcguaaugagcugccuucugcggggcuugccuucuggccaugcccuucuucucucccuugcaccuguaccucuuggucuuugaauaaagccugaguaggaag

SEQ ID NO: 1651 - RNA, 1796 nt, Artificial Sequence
  Description of Artificial Sequence: Synthetic coding sequence
gggaaauaagagagaaaagaagaguaagaagaaauauaagagccaccaugccgccuccacgaacggggagaggauugcuguggcugggacugguauugucauccguaugcguggcccuuggaucagaaacccaggccaacagcacgaccgaugcccucaauguauuguugauuaucgucgaugaccucaggcccucccuuggguguuacggggacaaguuggucagaucgcccaauauugaccaacucgcgucgcauucgcucuuguuucagaaugccuuugcucagcaggcagugugcgccccaagccggguguccuuuuugaccggacgcaggccagauacaacgcgccuguaugacuucaauuccuacuggaggguacaugcggguaauuucucgacaaucccacaguauuucaaggaaaacgguuauguaacgaugucaguggggaagguguuucacccugguaucucgagcaaccacaccgacgauucacccuacucgugguccuuuccucccuaucaucccuccucggagaaauacgagaacacuaagacuuguagaggccccgauggggagcugcacgcuaacuugcugugccccguggacguacuggaugucccagaaggaacauugccggacaaacagucaacagagcaggcgauucaguugcuugaaaagaugaaaacgucagcgucgccuuucuuccucgcggucggauaucauaagccucacaucccuuuucgguauccaaaagaguuccagaaauuguacccgcucgaaaacauuacucuugcgcccgaccccgaggugccagacggacuucccccuguagcauacaaucccuggauggacauccggcagcgggaggacguccaggcacuuaacaucuccgucccguaugguccgaucccgguggauuuccagcgaaagauuagacagagcuauuucgccagcgugucguacuuggauacccaaguggguaggcugcuuuccgcccucgaugaucugcagcucgcaaauucaacaauuaucgcguucacgucagaccaugggugggcgcucggagaacauggcgagugggccaaguauuccaacuucgacguagcuacacacgucccucugauuuucuacgugcccggacgcacggcgucgcuccccgaggcaggggagaaacuguucccuuacuuggacccguucgacucagccucacagcuuauggaacccgggagacagagcauggaucuuguggagcucgucucgcucuuuccgacacuugcgggccuugcggggcuccaagugccaccgcgcugucccgugccgucguuucacgucgaacugugcagagaggguaaaaacuugcugaagcauuuucgguuccgggaucucgaagaagaucccuaucuccccggaaauccgcgagagcugaucgcauacucccaguacccacgccccuccgacaucccucaauggaacucggacaagcccagccuuaaagacaucaagauuaugggcuauucgaucaggacuauugauuacagauacacggucugggucggcuuuaacccggaugaauuucucgcuaacuucucagacauccacgcuggugagcuguauuuuguggauucagacccgcuccaagaucacaauauguacaacgauagccaaggaggggaucuuuuucaguuguugaugccgugauaagcugccuucugcggggcuugccuucuggccaugcccuucuucucucccuugcaccuguaccucuuggucuuugaauaaagccugaguaggaag

SEQ ID NO: 1652 - RNA, 2105 nt, Artificial Sequence
  Description of Artificial Sequence: Synthetic coding sequence
gggaaauaagagagaaaagaagaguaagaagaaauauaagagccaccaugcggccacucaggcccagggcagcccuucucgcucugcucgcgucacuucucgcggcaccacccguggcgccagcugaagcgccacaccugguacacgucgaugccgcgagggcacucuggccccuuagacgguucuggcggucgacuggguucuguccaccccuuccccauucccaagcagaucaguaugucuugucaugggaccagcagcugaaccuggcauacgugggagccgucccgcacaggggcaucaagcaggucagaacucacuggcucuuggaguugguaacgacacggggaagcacgggaagggggcucucauacaacuucacgcaucucgacggguacuuggauuugcuucgcgagaaucaacugcugccaggguucgagcuuauggggucggccucgggacauuucacggacuucgaggacaagcagcaagucuuugaguggaaagaucucguaucaucacuugcgcgcagauacaucggacgguauggauuggcgcacguaucgaaauggaauuucgaaacguggaacgagcccgaccaccacgauuuugacaacgugucgaugacaaugcagggguucuugaacuacuaugaugcgugcagcgaaggucuuagagccgcguccccugcguugcgccuggguggaccaggggacagcuuccacacacccccgagaucaccgcugucgugggggcuuuugcgacauugucacgacggaaccaacuucuuuacuggagaggcuggugugagacuggacuacaucucccugcaucgcaagggagcgcggagcucgaucucgauucuugaacaggagaagguaguggcacagcagauucggcagcucuuccccaaauucgccgacacgccuaucuacaacgaugaagcggauccccucgucgguuggucacucccccaaccuuggcgagcggacgugacguaugccgccauggugguaaaggugaucgcgcaacaccagaauuugcuguuggcgaauacaacaucagcguucccauaugcguuguuguccaacgacaaugccuuccugucguaucacccccaucccuuugcgcagaggacacugacagcacgguuucaagucaacaauacgaggccaccccaugugcagcucuugagaaagccgguguugaccgccauggggcucuuggcacugcuggaugaagaacagcuuugggccgaggugucacaggcggguacuguguuggauucaaaccacacaguggggguacucgcguccgcgcacagaccgcagggacccgcagacgcguggagagcugcaguacuuaucuacgcgucggacgacacgagagcccauccgaaucgcuccguggccguaacccugcgguugcgcggagucccgccuggucccggacuugucuacgucaccagauaucucgauaauggacugugcagccccgacggggaguggcgacggcuggggcgacccgucuuuccgacugcugaacaguuuagaagaaugcgagcagccgaagaucccgucgccgcugcaccucgaccucuucccgcugguggacgauugacgcuccgcccugcccuucgccuucccucguugcuucuggugcaugugugugccaggcccgagaaaccaccgggacaggugacaaggcuuagagcgcucccgcugacgcaagggcaacugguguugguguggucggacgagcacguaggguccaagugccucuggacauaugagauucaguuuagccaggaugggaaggcauauacuccugucucacgaaaaccuucgaccuucaaucuuuuugucuuuagccccgacacuggggcuguauccggaucguaccgggugagggcguuggauuacugggcuaggccuggcccguuuagcgauccagugccguacuuggaagucccuguccccagaggaccgccuagcccugguaacccgugauaagcugccuucugcggggcuugccuucuggccaugcccuucuucucucccuugcaccuguaccucuuggucuuugaauaaagccugaguaggaag

SEQ ID NO: 1653 - RNA, 476 nt, Artificial Sequence
  Description of Artificial Sequence: Synthetic coding sequence
gggaaauaagagagaaaagaagaguaagaagaaauauaagagccaccauggcucucuggaugcggcuucuuccacugcucgcccucuuggcguuguggggacccgacccugcagcagcguuugugaaucagcaccucugcgggucccaucuggucgaagcccuuuaccuuguguguggcgagcgcggguucuucuacacgcccaagacaaggcgcgaggcggaggaucuccaaguagggcagguggaauugggagggggaccgggagccgguucacuccagccccuggcguuggaggggucgcugcagaaaagagguauugucgaacaguguugcacuagcaucugcucgcuguaucaacuugagaacuauuguaacugaagcgcugccuucugcggggcuugccuucuggccaugcccuucuucucucccuugcaccuguaccucuuggucuuugaauaaagccugaguaggaag

SEQ ID NO: 1654 - RNA, 710 nt, Artificial Sequence
  Description of Artificial Sequence: Synthetic coding sequence
gggaaauaagagagaaaagaagaguaagaagaaauauaagagccaccauggccuugacguucgcccuucucguagcccuguuggugcucucaugcaaaucguccuguuccgucggaugcgaucuuccccagacgcauucgcuggggucgcgcagaacucucauguuguuggcgcagaugaggcgaauuagccuuuucucgugucuuaaggaccggcacgauuuugguuucccucaagaggaguuuggcaaccaguuccagaaggcggaaacaauccccguacuccacgagaugauccagcagaucuucaaccuguuuuccacgaaggacuccucagcggcuugggacgaaacccugcuggauaaguuuuacacggagcucuaucagcagcugaaugaccucgaagcaugugugauucaaggagugggggucaccgagacaccgcuuaugaaggaagauucaauccuugcagugcggaaauacuuucagaggaucacuuuguaucuuaaagagaaaaaguacagcccgugcgcgugggaagucgugagagcggagauuaugcgaagcuucucgcugagcacaaauuugcaagagucgcuccgcucaaaagaaugauaagcugccuucugcggggcuugccuucuggccaugcccuucuucucucccuugcaccuguaccucuuggucuuugaauaaagccugaguaggaag

SEQ ID NO: 1655 - RNA, 707 nt, Artificial Sequence
  Description of Artificial Sequence: Synthetic coding sequence
gggaaauaagagagaaaagaagaguaagaagaaauauaagagccaccaugaccaacaagugucugcuccagaucgcacucuuguugugcuucucgacgacugcccuuucgaugucauacaaucugcugggauuccuucagaggagcucgaauuuucagugucagaaguuguuguggcaacucaaugggcgacucgaguacugcuugaaagaucggaugaacuuugacauucccgaagaaaucaagcaacugcagcaauuccagaaagaggacgcggcucugacaaucuacgagaugcuucagaacauuuucgcgaucuucagacaggacagcucauccacgggcuggaacgagacaaucguagaaaaccugcucgcaaacgucuaucaccagauuaaucaccucaagacagugcuugaggagaagcuugaaaaagaagauuucacucgcgggaaacugauguccucgcuccauuugaaaagguacuauggaaggauuuugcacuaucucaaggccaaggaguauucccauugcgcguggaccaucgugcgcgucgagauccuucggaacuuuuacuuuaucaaucgguugacggguuaccucagaaauugauaagcugccuucugcggggcuugccuucuggccaugcccuucuucucucccuugcaccuguaccucuuggucuuugaauaaagccugaguaggaag

SEQ ID NO: 1656 - RNA, 677 nt, Artificial Sequence
  Description of Artificial Sequence: Synthetic coding sequence
gggaaauaagagagaaaagaagaguaagaagaaauauaagagccaccauguuucacgugucauuucgguauaucuuugggcugccuccgcuuauccucguacuccuccccguggccuccucagacugcgacauugaggggaaagacgggaagcaguacgaaucgguacuuauggucagcaucgaccagcucuuggacucgaugaaggaaaucgggucgaauugucugaacaaugaguucaacuucuucaagcgacauaucugugaugcuaacaaagagggaauguuccuguuuagagcggcgagaaaacugcgccaguuuuugaagaugaauucaaccggugauuucgaucuucaccugcuuaaaguguccgaggguacaacuauccuccuuaacugcacgggacaggucaagggacggaaaccggcagcgcucggagaagcccaacccacaaagucgcuggaggaaaacaagagcuugaaggaacagaagaaauugaaugaucucugcuucuugaaaagguugcuucaagagauuaagacguguuggaauaagauuuugaugggcacgaaagagcauugauaagcugccuucugcggggcuugccuucuggccaugcccuucuucucucccuugcaccuguaccucuuggucuuugaauaaagccugaguaggaag

SEQ ID NO: 1657 - RNA, 1343 nt, Artificial Sequence
  Description of Artificial Sequence: Synthetic coding sequence
gggaaauaagagagaaaagaagaguaagaagaaauauaagagccaccaugaagaugcgcuuucucgggcucguaguaugccugguccucuggacgcugcacucggagggauccaggggaaagcugacggccguagaccccgaaacgaauaugaaugucucggagauuaucuccuauuggggcuuuccgucagaggaguaucugguagagacagaggaugguuacaucuugugucucaaccggaucccccacggacggaaaaaccacucggauaaaggaccgaagccggucguguuucuucagcacggacuucuggccgacuccucgaauugggugacgaauuuggcgaacuccucguugggguuuauccucgcggacgccggauuugauguguggaugggcaacucgcgagguaacacguggucaaggaaacauaaaacccugucagucucgcaagacgaguucugggcauucucguacgaugaaauggcgaaguaugaccugcccgcgucaauuaacuucauccucaauaagaccggacaagaacagguauacuaugugggccauagccagggaacaacgaucggguuuaucgcuuucagccagaucccggagcucgcuaagcgcaucaagauguucuucgcgcucgggccuguggcgucaguggcguucugcacgucgcccauggcaaaauuggguagauugcccgaccaucuuaucaaagaucuguuuggggauaaggaauuucugccgcagucggccuuccucaaaugguuggggacacacgucuguacucacgugauuuugaaagaacuuugcgggaacuugugcuucuugcuuuguggauucaaugagcggaauuugaauaugucaagagucgaugucuacaccacccauucaccagcaggaacaucaguccagaauaugcugcauuggucccaagcggucaaauuccagaaguuccaagcauuugacuggggcucgagcgccaaaaacuauuuccacuauaaccagucguacccgccuacuuacaauguaaaggacaugcuuguccccacugcgguguggagcggugggcacgauuggcuugcggacguguaugaugugaacauucuucucacacagaucacaaaccugguguuucaugaguccauucccgaaugggaacaccucgacuucaucugggguuuggacgccccuuggaggcucuacaacaagauuaucaacuugaugcgaaaguaccagugauaagcugccuucugcggggcuugccuucuggccaugcccuucuucucucccuugcaccuguaccucuuggucuuugaauaaagccugaguaggaag

SEQ ID NO: 1658 - RNA, 2396 nt, Artificial Sequence
  Description of Artificial Sequence: Synthetic coding sequence
gggaaauaagagagaaaagaagaguaagaagaaauauaagagccaccauguugcgcgccaaaaaccagcuuuuucuucugucaccucacuaccuucgccaggugaaggaaucauccggcagcagacugauccagcagcgccugcugcaccagcaacaaccccuucaccccgagugggccgcacucgcuaagaagcaacuuaaagggaaaaacccggaggaccuuaucuggcacaccccagagggaaucucaaucaaaccacucuacucaaaaagagauaccauggaucugccggaggaguugcccggaguaaagccguucacgagaggacccuaucccaccauguacaccuuuagacccuggacuauccgccaguacgccggguucagcacaguagaagagucaaacaaguuuuacaaagacaacaucaaggcugggcagcagggguugucgguagccuucgaccucgcgacgcaucgcggcuacgacuccgacaauccgagggucagaggggacguggguauggcgggaguagcaaucgauaccgucgaggacacuaagauuuuguucgaugggauuccucuggagaaaaugagcgugagcaugacgaugaauggggccguaauuccggucuuggcgaacuuuaucgucacuggagaagaacagggagucccgaaggaaaagcucaccgggacuauccagaacgacauuuugaaagaguucaugguccgcaacacuuacaucuuuccgccugagccuucgaugaaaaucaucgccgacaucuucgaguauacggcuaaacacaugccgaaguuuaacucgauuucaauuucaggguaucauaugcaagaagcaggagcggaugcaauccuugaguuggcguauacguuggcggacggccuugaauauagcaggaccgggcugcaagcgggacucacaauugacgaguucgcacccagacugucguuuuucugggguauugggaugaauuucuauauggagauugccaaaaugcgggcaggacgcagacucugggcccaucucaucgagaaaauguuucaacccaaaaacucaaagucgcucuugcuucgggcgcacugccagacgucgggauggagcuugacagagcaggaccccuacaauaacaucguacggacagcaaucgaggcgauggcagcgguguuugggggaacgcagagccuccauacaaauuccuuugaugaggcgcugggauugcccacggucaaaucagcccgaaucgcgaggaauacucagaucaucauccaagaagaaucgggaaucccgaagguggcagaccccugggguggaucguacaugauggagugucugacaaaugacguguacgaugcggcgcugaaacucaucaacgagaucgaggagaugggagggauggccaaggcgguggcagaagggauuccuaagcugcgaauugaggaaugcgcagcgcggaggcaggcgcggaucgacucgggcuccgaggugauugugggggucaacaaauaucagcuugagaaggaggacgccguagaagugcuggcuaucgacaauacgucagugcggaauagacagaucgaaaaguugaagaaaaucaagucgagccgcgaccaggcacuggcagaaaggugcuuggcagcccugacggaaugugcggcgucaggugaugggaacauccuugcguuggccgucgaugccucaagagcacgcuguacagugggggagaucacugacgcuuugaagaagguauuuggagagcauaaggcaaaugaucggaugguaucgggugccuaucggcaggaguuuggugaaagcaaggagaucacgucagcgaucaagaggguacacaaguucauggagagagagggaaggcgaccccgcuugcuuguagccaagaugggacaagauggacacgauagaggcgcgaaggugaucgcgacgggguuugcggaucucgguuucgacguagauauuggaccccuuuuccagacaccucgcgaagucgcgcagcaggcagucgaugcugauguccacgcagugggaauuucgacauuggcggcagggcauaaaacccuugucccagagcucaucaaggagcuuaauucccucgguagaccugacauucuggugaugugcgggggagugauuccgccccaagauuacgaguucuuguucgaggucggagucagcaacguguuugggccagguacaagaauccccaaagccgcagugcaagugcucgaugacauugagaagugucucgaaaagaaacaacaguccgucuaaugagcugccuucugcggggcuugccuucuggccaugcccuucuucucucccuugcaccuguaccucuuggucuuugaauaaagccugaguaggaag

SEQ ID NO: 1659 - RNA, 1208 nt, Artificial Sequence
  Description of Artificial Sequence: Synthetic coding sequence
gggaaauaagagagaaaagaagaguaagaagaaauauaagagccaccaugcucuuuaaccuccgcauccuguugaauaacgcugcguuccgaaaugggcauaacuucaugguacgcaacuucagaugcggccagccacuccagaacaaggugcagcuuaaaggucgggaccuccuuacucugaagaacuuuaccggagaagagaucaaguacaugcuguggcuuucagcggauuugaaguuucgcauuaaacagaagggagaguaucuuccccucuugcaagggaagucgcucgggaugaucuucgagaagcgcucgacaaggacccggcucagcaccgaaaccggauuugcgcuguugggagggcacccguguuuucucacgacgcaagacauucacuugggagugaaugagucguugacagacacugccagaguccuuucaucgauggccgaugcggugcuugcgagggucuacaaacagucggaucuugacacacuggccaaggaagccucgaucccgaucauuaacgggcucucggauuuguaccacccaauccagaucuuggcggauuaucuuacauugcaagagcauuauuccucccucaaggggcugacucucagcuggauuggugacggaaauaacauccuccauucaaucaugaugagcgcagcgaaauucggaaugcaccuccaagcggccacgcccaaagguuaugaaccugaugcgagcguaacuaaacucgcggagcaguaugcaaaggaaaauggcacgaaacucuugcucacaaaugaccccuuggaggcagcacacggugguaauguccugauuacagacacauggaucuccauggggcaggaggaggagaaaaagaaaagacuucaggcauuucagggauaccagguaacgaugaaaacggcgaaggucgccgccucagacuggacuuuccuccauugccugccgaggaagccggaagaagucgaugaugagguguuuuacagcccccgaucccugguguucccugaagccgaaaaucggaaguggacaauuauggcagugauggugucccuucuuacggacuacucgccccagcugcaaaaaccgaaauucuaaugagcugccuucugcggggcuugccuucuggccaugcccuucuucucucccuugcaccuguaccucuuggucuuugaauaaagccugaguaggaag

SEQ ID NO: 1660 - RNA, 1502 nt, Artificial Sequence
  Description of Artificial Sequence: Synthetic coding sequence
gggaaauaagagagaaaagaagaguaagaagaaauauaagagccaccauguccaccgcagugcuugaaaauccgggguugggccggaagcucuccgacuucggacaggaaacgucguauaucgaggauaauugcaaccagaauggggccaucucgcucaucuucucacugaaagaagaggugggagccuuggcuaaagucuugagacuguucgaagagaacgaugugaaucucacgcacaucgaaagccgcccaagcagauugaaaaaggacgaguacgaguucuuuacacauuuggacaaaaggucgcugccugcgcucacaaauaucauuaagauucuccgccaugauaucggagcaacaguccacgaacuuucgagggacaagaagaaagauacggugcccugguucccgagaaccauccaagagcucgaccgauuugcgaaccagauucuuucguauggagcggaacucgacgccgaucauccaggguuuaaggacccgguguacagggcacgacgcaagcaguucgccgauauugccuauaacuaucgccauggucaaccgauuccacggguagaauacauggaagaggagaaaaagacuugggggacuguguucaagacguugaagucgcucuauaagacgcacgcaugcuaugaauacaaccauaucuucccucugcucgagaaguauuguggauuccacgaggauaacauuccccagcucgaggacguaagccaguuccuucagacaugcacgggguuuagacuuaggcccgucgcgggacuucuuuccucgagagauuuccucggggguuuggcauuucgagucuuucacuguacccaguauauucggcacgguuccaaaccuauguacacccccgagccggauaucugccaugaauugcugggacacguaccacuguuuagcgaccggagcuuugcucaguuuagccaggagaucggauuggcaucauugggugcgcccgacgaguacauugagaaacuggcgacuaucuacugguuuacgguggaauuuggccugugcaagcaaggcgauucaaucaaggcguacggugcgggguugcucucgucguucggggaacugcaauacugucuuucggagaaaccgaaacuccuuccccucgaguuggaaaagacggcuauccagaauuacacuguaacggaguuccagcccuuguauuacgucgccgaguccuuuaaugacgccaaagagaaagugagaaacuucgcggcgacaaucccccgaccauuuucgguccgguacgauccuuauacacagcgcauugagguccuugacaauacucaacagcugaagauccucgccgauucaauuaacucagagaucggaauucucuguucagcgcuccagaagaucaagugauaagcugccuucugcggggcuugccuucuggccaugcccuucuucucucccuugcaccuguaccucuuggucuuugaauaaagccugaguaggaag

SEQ ID NO: 1661 - RNA, 1832 nt, Artificial Sequence
  Description of Artificial Sequence: Synthetic coding sequence
gggaaauaagagagaaaagaagaguaagaagaaauauaagagccaccauggaugccaugaaacggggguuguguugcguacuucuuuugugcggagcgguguucguguccccgucgcaagagauccacgcgcgauucagaaggggugcgcggagcuaccaggucaucugccgagaugagaaaacucagaugaucuaccaacagcaucaguccuggcugcggccuguacugcgcuccaaccgaguggaauacugcugguguaauagcggcagggcccagugccauucaguaccgguaaagucgugcucggaaccgcgcugcuuuaauggcgggacaugucagcaggcgcuuuacuucuccgauuucgugugucagugcccagaaggguucgcgggcaaaugcugcgaaaucgacacacgggcgacguguuaugaagaucagggaauuagcuaccgggguacguggucgacggccgagucgggggcagaguguaccaacuggaacagcucggcgcuggcgcagaagcccuauucgggacgaaggccggacgccaucagauugggacuuggaaaucacaacuacugucgcaacccugacagagacucaaaacccugguguuaugucuuuaaggcggggaaauacucaucggaguucugcucgacccccgcaugcucagaggguaacucggauugcuauuuuggaaaugguuccgccuaccgcggaacgcacuccuugacugaaucgggugccagcugucugcccuggaacucaaugauccugaucggaaaaguguacaccgcgcagaacccaagcgcacaggcacuuggacucgguaaacacaauuacugccgcaaucccgacggggaugcgaagcccuggugucacgucuugaagaauagaaggcucacgugggaguauugugacguccccagcugcucaacgugugggcucaggcaguauucacagccgcaguuccggaucaaggguggacuuuuugcagacaucgcaucgcaccccuggcaggcugccaucuuugcgaagcaucgacggagcccgggagagcgcuucuuguguggcgggauucucauuucaucaugcuggauucucucggcggcucacugcuuucaagaacgauuucccccgcaccauuugacggucauucucgggagaacguaccgcguagugccgggagaggaagaacaaaaguucgagguggagaaguauaucgugcauaaagaguucgacgacgacacguaugacaacgauaucgcucugcuccaguugaagagcgauucaucgcggugugcacaagagucauccguagucagaacgguaugccugcccccugcugacuugcagcugccagauuggacagaaugcgagcuuucgggauauggaaagcaugaagccuugagcccguucuauucggagcgguugaaagaggcccaugugcgccuguacccaucgucacgcuguacaucccagcaccuucucaaccggaccgugaccgacaacaugcuuugugcaggggauacaaggagcgggggaccccaggcgaauuugcacgaugccugucaaggugauucggguggcccgcuugucugccugaacgaugggagaaugacacuggugggaaucauuucguggggguuggggugugggcaaaaggaugucccgggugucuacacuaaagugacaaauuaccuugacuggauuagagacaauaugaggccaugauaagcugccuucugcggggcuugccuucuggccaugcccuucuucucucccuugcaccuguaccucuuggucuuugaauaaagccugaguaggaag

SEQ ID NO: 1662 - RNA, 1400 nt, Artificial Sequence
  Description of Artificial Sequence: Synthetic coding sequence
gggaaauaagagagaaaagaagaguaagaagaaauauaagagccaccaugccgucaucagugucguggggaauccuucuuuuggcgggacuuugcugccuugugcccguaucauuggccgaagauccccaaggugacgcggcucaaaagaccgauacaucccaccacgaccaggaccauccgacguucaauaagauuacgcccaauuuggcggaauuugccuucucccuuuauagacagcuugcacaucagagcaauucaacuaacaucuucuucucgccggugucaaucgcaacugccuuugcgauguugucccucgggacuaaggccgacacucacgaugagauccucgaagggcucaauuucaaccuuacugaaauucccgaggcccagauucacgagggguuccaagagcuucuccgcacacucaaccagccggacagccaguugcagcugaccacagggaacgguuuguuuuugagcgaaggacugaaacuuguagacaaauuccucgaagaugugaagaaacuuuaucacuccgaggcguucacagugaacuucggagacaccgaggaagcgaaaaagcaaaucaaugacuaugucgagaaagggacacagggcaaaaucguagaccucgugaaagagcuggacagggauacgguauuugcguuggugaacuacaucuuuuucaagggaaaaugggagcgacccuuugaggugaaagauacugaggaagaagauuuucacguagaucaagugacgacggucaaaguaccuaugaugaagagauuggggauguucaauauccagcauuguaagaaacugucgucguggguccugcucaugaaauaccucggaaaugcgacugcuaucuuuuuccuucccgacgaaggaaaguugcagcaccucgaaaacgagcugacacaugacauuaucacgaaguuccuugagaacgaggaccggcgcucggcauccuugcaucugccgaaauugucgaucaccgguacguacgaucucaagagcguccuugggcagcuuggaaucaccaagguauuuucgaacggagccgaucuuuccggugugacggaagaggcgccauugaaguuguccaaggcugugcauaaggccguccucacaauugaugagaagggaacggaagcggcaggggcaauguuucucgaggcgaucccaaugucgauuccgccugaggucaaguucaacaagccuuuugucuuucuuaugauugagcagaauaccaagucgcccuuguuuaugggcaaagucgugaauccuacccagaagugauaagcugccuucugcggggcuugccuucuggccaugcccuucuucucucccuugcaccuguaccucuuggucuuugaauaaagccugaguaggaag

SEQ ID NO: 1663 - RNA, 1502 nt, Artificial Sequence
  Description of Artificial Sequence: Synthetic coding sequence
gggaaauaagagagaaaagaagaguaagaagaaauauaagagccaccauguuugacauugaguauuuucggaaagacccuaggccguucuuuaaguuugccaaagaaaucuacccugggcaguuccagcccagccuuugccacaaguuuaucgccuugucggauaaagagggaaaauugcuuaggaacuacacccagaacaucgauacguuggaacaggucgcagggauccagaggaucauccagugccacgggucauuugcuacugcauccugucucauuuguaaguacaaaguggauugugaggcggugcggggagauaucuuuaaucaagucguaccccgaugcccucgcugcccagcggacgaaccauuggcgaucaugaagcccgaaaucgucuuuuucggcgaaaaucucccagagcaguuccaucgcgccaugaaguaugacaaggaugaaguggacuugcugaucgucaucggcucgucacugaaaguaagacccguagcguugauucccucgucaauuccccaugaggugccucaaauucugauuaacagggagccccuuccccaucuccacuucgaugucgagcuuuugggggacugugacgucaucauuaacgaacugugucaccgacuuggaggggaauaugcgaaauugugcugcaacccggugaaauugucggagauuacagaaaaaccgcccagaacgcagaaagagcuggcguaccucuccgagcugcccccgaccccucugcaugugucggaggacagcuccucgcccgaacggaccuccccaccggacucaucggucauugugacgcuccuugaccaggcagcgaagucgaaugaugaucuggauguaagcgagucaaagggcuguauggaagagaagccccaagaagugcaaacgucgcgcaauguggagucaaucgccgaacaaauggagaacccugaccucaaaaacguaggaucgucaacaggggaaaagaacgaacggacgucgguggccggaacagucagaaagugcuggccuaauagaguagccaaggagcagaucucgcggcgacuggaugggaaucaauaccuuuuccuucccccaaacagguauaucuuccacggagcggagguauauucagauucggaggacgauguauugucaucaucgagcuguggaucaaacucggauucggguacaugccagagccccucgcucgaggagccuauggaggacgaaagcgagaucgaggaguucuacaauggacucgaggacgagccugacgucccagaaagggcggguggagcgggguucgguacugauggagaugaccaagaagcaauuaacgaagccaucuccgugaagcaggaagugacggauaugaacuauccguccaauaaguccugauaagcugccuucugcggggcuugccuucuggccaugcccuucuucucucccuugcaccuguaccucuuggucuuugaauaaagccugaguaggaag

SEQ ID NO: 1664 - RNA, 1502 nt, Artificial Sequence; identical to SEQ ID NO: 1663
  Description of Artificial Sequence: Synthetic coding sequence

SEQ ID NO: 1665 - RNA, 1211 nt, Artificial Sequence
  Description of Artificial Sequence: Synthetic coding sequence
gggaaauaagagagaaaagaagaguaagaagaaauauaagagccaccauguccgugaauuaugccgcuggucuuuccccguacgccgauaaaggaaaguguggccucccugagauuuuugacccgccagaggaguuggaacgcaaagucugggaguuggccagguugguauggcagucgucaucggugguauuucauacgggagcuggaauuucaacggcaucgggaaucccggauuuucgggguccccacggagucuggaccauggaggaaagggggcucgccccuaaguucgauacgacauuugagagcgcacgcccaacucaaacccauauggcccuggugcagcuggaaagggucggacuucuccgcuuccucgugucgcagaauguagacggauugcacgugagauccggauucccaagggauaagcuggcggagcugcacgguaacauguucgucgaggaaugcgcgaaguguaaaacucaguacgugcgggauacaguagucggaacaaugggacugaaggcgaccgggcgacuuuguaccguagcaaaggcgagaggauugagagcgugccggggugaauugcgggacacaaucuuggacugggaggacucgcuuccggaucgagaucuggcccucgcggacgaagcgucgcgaaacgcggaccugucgauuacucugggcacaucacugcaaauccgccccagcgggaaccucccucuugcaacaaaacggcgaggcgguagacuggucauugucaaccuccagccgaccaaacacgaccggcacgccgacuugagaauccauggguauguagaugaggugaugacgcgcuugaugaaacaucucggguuggagaucccggcuugggacgggccaaggguccuugagagggcgcucccgccuuugccaagacccccgacgcccaagcuggaaccaaaggaagaauccccgacgagaaucaauggcucaauccccgcugggccuaaacaggaaccgugcgcgcagcauaauggguccgagcccgcaucacccaaacgagaaaggcccacaucgccugcaccgcacagacccccaaagaggguaaaagcgaaagccgugcccucguaaugagcugccuucugcggggcuugccuucuggccaugcccuucuucucucccuugcaccuguaccucuuggucuuugaauaaagccugaguaggaag

SEQ ID NO: 1666 - RNA, 2039 nt, Artificial Sequence
  Description of Artificial Sequence: Synthetic coding sequence
gggaaauaagagagaaaagaagaguaagaagaaauauaagagccaccaugccgcgauacggcgcaucacuucggcagucguguccgagaucgggaagggagcaagggcaggaugggaccgccggagcgccuggacucuuguggauggggcucguccuggcucuggcgcucgcucuggcccuugcauuggcuuuguccgacagccgagucuugugggcaccggcagaggcccacccacugucgccccaagggcaccccgcgagacuccaucgaaucgugcccagauugcgggauguguucgguugggguaacuugacaugccccauuugcaaagggcucuuuacagcgaucaacuuggguuugaagaaggagcccaacgucgccagagucgggucgguggcgaucaaguugugcaaucuccucaagaucgcaccucccgcagucugccagucaauugugcacuuauuugaggaugacaugguagagguguggcgccgaagcgugcugucgccaagcgaggcgugugggcugcugcucggaucaacguguggccacugggacaucuucucaucguggaauaucucauugccgacggucccaaaaccaccuccaaagccuccuuccccgccugccccuggagcgccggugucgcggauucuguucuugacagaccuucacugggaucacgacuaucuugaggguacagaucccgacugcgcggacccgcuuugcugccgcaggggaucgggguugcccccugcaucgcgacccggugcugguuauuggggcgaauacucaaagugugaccuuccccugcgcacccucgaaucgcuuuugagcggccuuggacccgcggggcccuucgauaugguguauuggacuggcgacauuccggcgcaugauguguggcaccagacucgacaggaccagcuucgagcgcucacaacggugacagcacuggugcggaaauuucucggaccagugccaguauacccugcgguagguaaccaugaaucgacgccugucaauagcuucccuccgccuuuuaucgagggcaaucauagcucgcgguggcucuacgaggcgauggcgaaggcgugggaaccguggcuuccggcggaggcguugagaacucuuagaaucggugguuuuuacgcgcuuagcccauacccuggucugaggcucaucucacugaacaugaauuucuguucacgggaaaacuucuggcuucugaucaauucgacagacccggcagggcagcuccaguggcuggucggagaauugcaggccgcagaggaucgcggagacaaaguacacaucauugggcacauuccucccggacacugucucaaaagcuggucguggaauuacuaucgcaucgucgcuagauacgagaacacgcuugcggcgcaguuuuucgggcacacccacgucgaugaguuugagguauucuaugaugaagaaacguugucccgaccccuggcggucgcauucuuggcgcccucggccacgacguacauugggcucaacccuggauaccgcguauaucagauugauggaaacuauagcggaagcagccacgucguacuugaccacgaaacguacauucugaaucugacccaggccaauaucccuggggccauuccccauuggcaacuucuguacagggcuagggaaacauauggucugccuaacacuuugcccacggcguggcauaaccucguguaucgcaugcgcggugauaugcaauuguuccagacguucugguuuuuguaccauaaggggcacccaccguccgagccgugcggaacccccugccgccucgcgacacugugcgcccaguugucggcuagagcagacucccccgcucucugucggcaucuuaugcccgacgggucccuccccgaagcgcagucgcuuuggcccaggccgcuguuuuguuaaugagcugccuucugcggggcuugccuucuggccaugcccuucuucucucccuugcaccuguaccucuuggucuuugaauaaagccugaguaggaag

SEQ ID NO: 1667 - RNA, 1205 nt, Artificial Sequence
  Description of Artificial Sequence: Synthetic coding sequence
gggaaauaagagagaaaagaagaguaagaagaaauauaagagccaccauggagcuuacggagcugcuccuugucgucauguugcugcugacggcgcgauugacacucucauccccugcaccucccgcgugcgacuugcggguccugucgaaguuguugcgagacucgcaugugcuccacucacgguugucgcaguguccagaggugcacccauugcccaccccgguguugcucccggcuguggauuucucgcuuggagaguggaaaacgcaaauggaagaaacuaaggcccaagacaucuugggagcggugacacuucuccucgaaggggugauggcugcaaggggucaauugggucccacaugccucuccagccucuuggggcagcuuuccggucaggugcggcuucugcuuggugcgcugcagagccugcuuggaacucaguugccaccgcaggggcgcacuaccgcgcacaaagaccccaacgccaucuuucuuuccuuucagcacuuguugcgcgguaaaguacgauuucucaugcucgucgguggcucgacacuuugugucagaagagcaccucccacaaccgcagugcccucccggacaagccuuguacugacgcucaacgagcuuccgaauaggacaagcgggcuccucgaaacuaacuuuacggcgucggccaggacgacgggaucaggccuucucaaguggcagcagggauuccgcgccaagaucccugguuuguugaaccagacaucgaggucauuggaucagauucccggguaucuuaauaggauucacgagcuucugaauggaacgagagggcuguucccgggaccauccagacggacgcucggagcccccgauaucucgucggggacgagcgacacagggucacugccucccaaucugcagccagguuacucgccuucccccacgcaucccccgacgggacaauacacgcucuucccccuuccgccuacacugccuaccccgguaguacagcuccauccguugcugcccgauccaucagcgccgacccccacacccaccagcccgcuucucaacacuucauauacgcauagccagaaccucucgcaagaaggauaaugagcugccuucugcggggcuugccuucuggccaugcccuucuucucucccuugcaccuguaccucuuggucuuugaauaaagccugaguaggaag

SEQ ID NO: 1668 - RNA, 1316 nt, Artificial Sequence
  Description of Artificial Sequence: Synthetic coding sequence
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 1669 - RNA, 1316 nt, Artificial Sequence
  Description of Artificial Sequence: Synthetic coding sequence
gggaaauaagagagaaaagaagaguaagaagaaauauaagagccaccaugaaugguacgcgcaacuggugcacucucguggaugugcacccggaagaucaggcagcuggguccgucgacauucuccggcugacacuucagggggaacugaccggggacgagcuggagcacaucgcgcagaaagcgggucgaaaaacauacgcgauggugagcucgcacucggcugggcacucccucgccucagaacugguggaaucacacgauggacaugaagagaucaucaaaguauaucucaagggacgcuccggagacaagaugauucaugagaagaauaucaaccaauugaagucagaaguccaguauauccaagaggcgcggaacuguuugcaaaagcugagagaggacauuucgucaaagcucgauaggaacuugggcgauagcuugcaccgacaggagauucaaguaguacucgaaaagcccaauggcuuuucccagucgccaaccgccuuguauucgucacccccugaggucgacacaugcaucaaugaggacgucgaaucacuuagaaagacagugcaagaccuuuuggcgaaacuccaagaagcgaagcgccagcaucagucggauuguguagccuucgaaguaacguugucaagguaccagagagaggcggagcagucgaacguggcgcuucaacgcgaagaggaucgcguagagcaaaaagaggcugaggucggugagcuucagagaagguugcucgggauggaaacggagcaccaggcacucuuggccaaagucagagagggagagguggcauuggaagaacuuagguccaacaaugcggauugccaggccgaacgggaaaaggcggccacucucgagaaagaggucgcgggauugcgagagaagauccaucauuuggacgacaugcuuaagucgcagcagcggaaagugaggcagaugaucgagcagcugcagaacucgaaagccgugauccaguccaaagaugcaacgauucaagagcucaaagagaaaauugcguacuuggaagccgagaaucucgaaaugcaugaccgcauggaacaccuuaucgaaaagcagauuucacacggaaauuucagcacgcaggcgagagcaaagaccgaaaacccggggucgauucggaucagcaaaccgccuucgccgaagcccaugcccgucaucagagucguggaaacguaaugagcugccuucugcggggcuugccuucuggccaugcccuucuucucucccuugcaccuguaccucuuggucuuugaauaaagccugaguaggaag

SEQ ID NO: 1670 - RNA, 1316 nt, Artificial Sequence; identical to SEQ ID NO: 1669
  Description of Artificial Sequence: Synthetic coding sequence

SEQ ID NO: 1671 - RNA, 1715 nt, Artificial Sequence
  Description of Artificial Sequence: Synthetic coding sequence
gggaaauaagagagaaaagaagaguaagaagaaauauaagagccaccauggcuggucagcgaguacuguugcuugugggauuccuuuugccugggguauuguuguccgaggcggcgaaaauccugacuaucuccaccgucgggggaucacacuaccuuuugauggacagagucucgcaaauucuccaagaccacggacauaaugugacaaugcuuaaccacaagaggggucccuuuaugcccgacuucaagaaagaggagaaguccuaccaggugaucagcuggcuggccccagaggaccaccagagggaguuuaagaaaucguuugauuucuuccuugaggaaacgcugggcggaagggggaaauuugaaaacuuguugaauguacuggaguacuuggcgcugcaguguagccacuuccuuaaccggaaagacaucauggacucgcugaaaaaugagaauuuugauauggugauuguagaaacguucgauuauugccccuuuuugaucgcggagaaguugggaaagcccuucgucgccauucucucgacgucauucgggucgcuggaauucgggcuccccauuccucugagcuaugucccuguauuccggucauugcugacagaccacauggauuuuugggggagaguaaagaauuuucucauguucuuuuccuuuugucggagacagcaacacaugcagucgaccuuugacaacacuaucaaggaacauuuuacggaaggcucacggcccgugcugucgcaucuccuguugaaagccgagcucugguuuaucaauucggauuuugcauucgacuucgcaagaccucuucuuccaaacacaguguaugucgguggacugauggagaaaccgaucaaaccgguaccccaagaucucgagaauuucaucgccaaauucggagauagcggguuuguccuugugacgcuugguuccauggugaacacaugucagaaucccgaaaucuucaaggagaugaacaacgccuucgcacaucugccucagggagucauuuggaagugccagugcagccacuggcccaaagacgugcacuuggcugcgaacgucaaaaucguggauugguugccgcagucggaccuguuggcgcauccgucaauccgccucuucgucacucauggcggucagaauucgauuauggaagcaauccagcauggaguccccaugguagggauuccgcuuuuuggagaucagccagaaaacauggucaggguagaggccaagaaauucggugugagcauccagcucaaaaagcuuaaggcggaaacauuggcgcucaagaugaaacaaaucauggaagauaaaagguacaagagcgcagcggucgcggcaucggucaucuugcgcagccauccguuguccccgacucagcgccucgugggguggauugaccacguacuucagaccgguggagcuacccacuugaagcccuauguguuccaacagcccuggcaugagcaguaccuguuugacguguuuguguuccuguugggacucacucuugguacgcucuggcucugcgggaaguugcuuggaauggcugugugguggcucagaggggcacggaaagucaaggagacaugauaagcugccuucugcggggcuugccuucuggccaugcccuucuucucucccuugcaccuguaccucuuggucuuugaauaaagccugaguaggaag

SEQ ID NO: 1672 - RNA, 716 nt, Artificial Sequence
  Description of Artificial Sequence: Synthetic coding sequence
gggaaauaagagagaaaagaagaguaagaagaaauauaagagccaccaugaacuuucucuugucaugggugcacuggagccuugcgcugcugcuguaucuucaucacgcuaaguggagccaggccgcacccauggcggaggguggcggacagaaucaccacgaaguagucaaauucauggacguguaccagaggucguauugccauccgauugaaacucuuguggauaucuuucaagaauaccccgaugaaaucgaguacauuuucaaaccgucgugugucccucucaugaggugcgggggaugcugcaaugaugaaggguuggaguguguccccacggaggagucgaauaucacaaugcaaaucaugcgcaucaaaccacaucagggucagcauauuggagagauguccuuucuccagcacaacaaaugugaguguagaccgaagaaggaccgagcccgacaggaaaacccaugcggaccgugcuccgagcggcgcaaacacuuguucguacaagacccccagacaugcaagugcucauguaagaauaccgauucgcgguguaaggcgagacagcuggaauugaacgagcgcacguguaggugcgacaagccuagacggugagcugccuucugcggggcuugccuucuggccaugcccuucuucucucccuugcaccuguaccucuuggucuuugaauaaagccugaguaggaag

SEQ ID NO: 1673 - DNA, 1182 bp, Artificial Sequence
  Description of Artificial Sequence: Synthetic coding sequence
atgaccacctacagcgacaagggcgccaagcccgagagaggcagattcctgcacttccacagcgtgaccttctgggtgggcaacgccaagcaggccaccagcttctactgcagcaagatgggcttcgagcccctggcctacagaggcctggagaccggcagcagagaggtggtgagccacgtgatcaagcagggcaagatcgtgttcgtgctgagcagcgccctgaacccctggaacaaggagatgggcgaccacctggtgaagcacggcgacggcgtgaaggacatcgccttcgaggtggaggactgcgactacatcgtgcagaaggccagagagagaggcgccaagatcatgagagagccctgggtggagcaggacaagttcggcaaggtgaagttcgccgtgctgcagacctacggcgacaccacccacaccctggtggagaagatgaactacatcggccagttcctgcccggctacgaggcccccgccttcatggaccccctgctgcccaagctgcccaagtgcagcctggagatgatcgaccacatcgtgggcaaccagcccgaccaggagatggtgagcgccagcgagtggtacctgaagaacctgcagttccacagattctggagcgtggacgacacccaggtgcacaccgagtacagcagcctgagaagcatcgtggtggccaactacgaggagagcatcaagatgcccatcaacgagcccgcccccggcaagaagaagagccagatccaggagtacgtggactacaacggcggcgccggcgtgcagcacatcgccctgaagaccgaggacatcatcaccgccatcagacacctgagagagagaggcctggagttcctgagcgtgcccagcacctactacaagcagctgagagagaagctgaagaccgccaagatcaaggtgaaggagaacatcgacgccctggaggagctgaagatcctggtggactacgacgagaagggctacctgctgcagatcttcaccaagcccgtgcaggacagacccaccctgttcctggaggtgatccagagacacaaccaccagggcttcggcgccggcaacttcaacagcctgttcaaggccttcgaggaggagcagaacctgagaggcaacctgaccaacatggagaccaacggcgtggtgcccggcatgtag

SEQ ID NO: 1674 - DNA, 1065 bp, Artificial Sequence
  Description of Artificial Sequence: Synthetic coding sequence
atgggcttcgagcccctggcctacagaggcctggagaccggcagcagagaggtggtgagccacgtgatcaagcagggcaagatcgtgttcgtgctgagcagcgccctgaacccctggaacaaggagatgggcgaccacctggtgaagcacggcgacggcgtgaaggacatcgccttcgaggtggaggactgcgactacatcgtgcagaaggccagagagagaggcgccaagatcatgagagagccctgggtggagcaggacaagttcggcaaggtgaagttcgccgtgctgcagacctacggcgacaccacccacaccctggtggagaagatgaactacatcggccagttcctgcccggctacgaggcccccgccttcatggaccccctgctgcccaagctgcccaagtgcagcctggagatgatcgaccacatcgtgggcaaccagcccgaccaggagatggtgagcgccagcgagtggtacctgaagaacctgcagttccacagattctggagcgtggacgacacccaggtgcacaccgagtacagcagcctgagaagcatcgtggtggccaactacgaggagagcatcaagatgcccatcaacgagcccgcccccggcaagaagaagagccagatccaggagtacgtggactacaacggcggcgccggcgtgcagcacatcgccctgaagaccgaggacatcatcaccgccatcagacacctgagagagagaggcctggagttcctgagcgtgcccagcacctactacaagcagctgagagagaagctgaagaccgccaagatcaaggtgaaggagaacatcgacgccctggaggagctgaagatcctggtggactacgacgagaagggctacctgctgcagatcttcaccaagcccgtgcaggacagacccaccctgttcctggaggtgatccagagacacaaccaccagggcttcggcgccggcaacttcaacagcctgttcaaggccttcgaggaggagcagaacctgagaggcaacctgaccaacatggagaccaacggcgtggtgcccggcatgtag

SEQ ID NO: 1675 - DNA, 1173 bp, Artificial Sequence
  Description of Artificial Sequence: Synthetic coding sequence
tacagcgacaagggcgccaagcccgagagaggcagattcctgcacttccacagcgtgaccttctgggtgggcaacgccaagcaggccaccagcttctactgcagcaagatgggcttcgagcccctggcctacagaggcctggagaccggcagcagagaggtggtgagccacgtgatcaagcagggcaagatcgtgttcgtgctgagcagcgccctgaacccctggaacaaggagatgggcgaccacctggtgaagcacggcgacggcgtgaaggacatcgccttcgaggtggaggactgcgactacatcgtgcagaaggccagagagagaggcgccaagatcatgagagagccctgggtggagcaggacaagttcggcaaggtgaagttcgccgtgctgcagacctacggcgacaccacccacaccctggtggagaagatgaactacatcggccagttcctgcccggctacgaggcccccgccttcatggaccccctgctgcccaagctgcccaagtgcagcctggagatgatcgaccacatcgtgggcaaccagcccgaccaggagatggtgagcgccagcgagtggtacctgaagaacctgcagttccacagattctggagcgtggacgacacccaggtgcacaccgagtacagcagcctgagaagcatcgtggtggccaactacgaggagagcatcaagatgcccatcaacgagcccgcccccggcaagaagaagagccagatccaggagtacgtggactacaacggcggcgccggcgtgcagcacatcgccctgaagaccgaggacatcatcaccgccatcagacacctgagagagagaggcctggagttcctgagcgtgcccagcacctactacaagcagctgagagagaagctgaagaccgccaagatcaaggtgaaggagaacatcgacgccctggaggagctgaagatcctggtggactacgacgagaagggctacctgctgcagatcttcaccaagcccgtgcaggacagacccaccctgttcctggaggtgatccagagacacaaccaccagggcttcggcgccggcaacttcaacagcctgttcaaggccttcgaggaggagcagaacctgagaggcaacctgaccaacatggagaccaacggcgtggtgcccggcatgtag

SEQ ID NO: 1676 - DNA, 438 bp, Artificial Sequence
  Description of Artificial Sequence: Synthetic coding sequence
atgagcaccgagggcggcggcagaagatgccaggcccaggtgagcagaagaatcagcttcagcgccagccacagactgtacagcaagttcctgagcgacgaggagaacctgaagctgttcggcaagtgcaacaaccccaacggccacggccacaactacaaggtggtggtgaccgtgcacggcgagatcgaccccgccaccggcatggtgatgaacctggccgacctgaagaagtacatggaggaggccatcatgcagcccctggaccacaagaacctggacatggacgtgccctacttcgccgacgtggtgagcaccaccgagaacgtggccgtgtacatctgggacaacctgcagaaggtgctgcccgtgggcgtgctgtacaaggtgaaggtgtacgagaccgacaacaacatcgtggtgtacaagggcgagtag

SEQ ID NO: 1677 - DNA, 4284 bp, Artificial Sequence
  Description of Artificial Sequence: Synthetic coding sequence
atgcaccagagacaccccagagccagatgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggcagaccccccagccccggcttccagagacagagacagagacagagaagagccgccggcggcatcctgcacctggagctgctggtggccgtgggccccgacgtgttccaggcccaccaggaggacaccgagagatacgtgctgaccaacctgaacatcggcgccgagctgctgagagaccccagcctgggcgcccagttcagagtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcaccagattcgacctggagctgcccgacggcaacagacaggtgagaggcgtgacccagctgggcggcgcctgcagccccacctggagctgcctgatcaccgaggacaccggcttcgacctgggcgtgaccatcgcccacgagatcggccacagcttcggcctggagcacgacggcgcccccggcagcggctgcggccccagcggccacgtgatggccagcgacggcgccgcccccagagccggcctggcctggagcccctgcagcagaagacagctgctgagcctgctgagcgccggcagagccagatgcgtgtgggacccccccagaccccagcccggcagcgccggccacccccccgacgcccagcccggcctgtactacagcgccaacgagcagtgcagagtggccttcggccccaaggccgtggcctgcaccttcgccagagagcacctggacatgtgccaggccctgagctgccacaccgaccccctggaccagagcagctgcagcagactgctggtgcccctgctggacggcaccgagtgcggcgtggagaagtggtgcagcaagggcagatgcagaagcctggtggagctgacccccatcgccgccgtgcacggcagatggagcagctggggccccagaagcccctgcagcagaagctgcggcggcggcgtggtgaccagaagaagacagtgcaacaaccccagacccgccttcggcggcagagcctgcgtgggcgccgacctgcaggccgagatgtgcaacacccaggcctgcgagaagacccagctggagttcatgagccagcagtgcgccagaaccgacggccagcccctgagaagcagccccggcggcgccagcttctaccactggggcgccgccgtgccccacagccagggcgacgccctgtgcagacacatgtgcagagccatcggcgagagcttcatcatgaagagaggcgacagcttcctggacggcaccagatgcatgcccagcggccccagagaggacggcaccctgagcctgtgcgtgagcggcagctgcagaaccttcggctgcgacggcagaatggacagccagcaggtgtgggacagatgccaggtgtgcggcggcgacaacagcacctgcagccccagaaagggcagcttcaccgccggcagagccagagagtacgtgaccttcctgaccgtgacccccaacctgaccagcgtgtacatcgccaaccacagacccctgttcacccacctggccgtgagaatcggcggcagatacgtggtggccggcaagatgagcatcagccccaacaccacctaccccagcctgctggaggacggcagagtggagtacagagtggccctgaccgaggacagactgcccagactggaggagatcagaatctggggccccctgcaggaggacgccgacatccaggtgtacagaagatacggcgaggagtacggcaacctgaccagacccgacatcaccttcacctacttccagcccaagcccagacaggcctgggtgtgggccgccgtgagaggcccctgcagcgtgagctgcggcgccggcctgagatgggtgaactacagctgcctggaccaggccagaaaggagctggtggagaccgtgcagtgccagggcagccagcagccccccgcctggcccgaggcctgcgtgctggagccctgccccccctactgggccgtgggcgacttcggcccctgcagcgccagctgcggcggcggcctgagagagagacccgtgagatgcgtggaggcccagggcagcctgctgaagaccctgccccccgccagatgcagagccggcgcccagcagcccgccgtggccctggagacctgcaacccccagccctgccccgccagatgggaggtgagcgagcccagcagctgcaccagcgccggcggcgccggcctggccctggagaacgagacctgcgtgcccggcgccgacggcctggaggcccccgtgaccgagggccccggcagcgtggacgagaagctgcccgcccccgagccctgcgtgggcatgagctgcccccccggctggggccacctggacgccaccagcgccggcgagaaggcccccagcccctggggcagcatcagaaccggcgcccaggccgcccacgtgtggacccccgccgccggcagctgcagcgtgagctgcggcagaggcctgatggagctgagattcctgtgcatggacagcgccctgagagtgcccgtgcaggaggagctgtgcggcctggccagcaagcccggcagcagaagagaggtgtgccaggccgtgccctgccccgccagatggcagtacaagctggccgcctgcagcgtgagctgcggcagaggcgtggtgagaagaatcctgtactgcgccagagcccacggcgaggacgacggcgaggagatcctgctggacacccagtgccagggcctgcccagacccgagccccaggaggcctgcagcctggagccctgcccccccagatggaaggtgatgagcctgggcccctgcagcgccagctgcggcctgggcaccgccagaagaagcgtggcctgcgtgcagctggaccagggccaggacgtggaggtggacgaggccgcctgcgccgccctggtgagacccgaggccagcgtgccctgcctgatcgccgactgcacctacagatggcacgtgggcacctggatggagtgcagcgtgagctgcggcgacggcatccagagaagaagagacacctgcctgggcccccaggcccaggcccccgtgcccgccgacttctgccagcacctgcccaagcccgtgaccgtgagaggctgctgggccggcccctgcgtgggccagggcacccccagcctggtgccccacgaggaggccgccgcccccggcagaaccaccgccacccccgccggcgccagcctggagtggagccaggccagaggcctgctgttcagccccgccccccagcccagaagactgctgcccggcccccaggagaacagcgtgcagagcagcgcctgcggcagacagcacctggagcccaccggcaccatcgacatgagaggccccggccaggccgactgcgccgtggccatcggcagacccctgggcgaggtggtgaccctgagagtgctggagagcagcctgaactgcagcgccggcgacatgctgctgctgtggggcagactgacctggagaaagatgtgcagaaagctgctggacatgaccttcagcagcaagaccaacaccctggtggtgagacagagatgcggcagacccggcggcggcgtgctgctgagatacggcagccagctggcccccgagaccttctacagagagtgcgacatgcagctgttcggcccctggggcgagatcgtgagccccagcctgagccccgccaccagcaacgccggcggctgcagactgttcatcaacgtggccccccacgccagaatcgccatccacgccctggccaccaacatgggcgccggcaccgagggcgccaacgccagctacatcctgatcagagacacccacagcctgagaaccaccgccttccacggccagcaggtgctgtactgggagagcgagagcagccaggccgagatggagttcagcgagggcttcctgaaggcccaggccagcctgagaggccagtactggaccctgcagagctgggtgcccgagatgcaggacccccagagctggaagggcaaggagggcacctag

SEQ ID NO: 1678 - DNA, 3309 bp, Artificial Sequence
  Description of Artificial Sequence: Synthetic coding sequence
atgttccagctgcccgtgaacaacctgggcagcctgagaaaggccagaaagaccgtgaagaagatcctgagcgacatcggcctggagtactgcaaggagcacatcgaggacttcaagcagttcgagcccaacgacttctacctgaagaacaccacctgggaggacgtgggcctgtgggaccccagcctgaccaagaaccaggactacagaaccaagcccttctgctgcagcgcctgccccttcagcagcaagttcttcagcgcctacaagagccacttcagaaacgtgcacagcgaggacttcgagaacagaatcctgctgaactgcccctactgcaccttcaacgccgacaagaagaccctggagacccacatcaagatcttccacgcccccaacgccagcgcccccagcagcagcctgagcaccttcaaggacaagaacaagaacgacggcctgaagcccaagcaggccgacagcgtggagcaggccgtgtactactgcaagaagtgcacctacagagaccccctgtacgagatcgtgagaaagcacatctacagagagcacttccagcacgtggccgccccctacatcgccaaggccggcgagaagagcctgaacggcgccgtgcccctgggcagcaacgccagagaggagagcagcatccactgcaagagatgcctgttcatgcccaagagctacgaggccctggtgcagcacgtgatcgaggaccacgagagaatcggctaccaggtgaccgccatgatcggccacaccaacgtggtggtgcccagaagcaagcccctgatgctgatcgcccccaagccccaggacaagaagagcatgggcctgccccccagaatcggcagcctggccagcggcaacgtgagaagcctgcccagccagcagatggtgaacagactgagcatccccaagcccaacctgaacagcaccggcgtgaacatgatgagcagcgtgcacctgcagcagaacaactacggcgtgaagagcgtgggccagggctacagcgtgggccagagcatgagactgggcctgggcggcaacgcccccgtgagcatcccccagcagagccagagcgtgaagcagctgctgcccagcggcaacggcagaagctacggcctgggcagcgagcagagaagccaggcccccgccagatacagcctgcagagcgccaacgccagcagcctgagcagcggccagctgaagagccccagcctgagccagagccaggccagcagagtgctgggccagagcagcagcaagcccgccgccgccgccaccggccccccccccggcaacaccagcagcacccagaagtggaagatctgcaccatctgcaacgagctgttccccgagaacgtgtacagcgtgcacttcgagaaggagcacaaggccgagaaggtgcccgccgtggccaactacatcatgaagatccacaacttcaccagcaagtgcctgtactgcaacagatacctgcccaccgacaccctgctgaaccacatgctgatccacggcctgagctgcccctactgcagaagcaccttcaacgacgtggagaagatggccgcccacatgagaatggtgcacatcgacgaggagatgggccccaagaccgacagcaccctgagcttcgacctgaccctgcagcagggcagccacaccaacatccacctgctggtgaccacctacaacctgagagacgcccccgccgagagcgtggcctaccacgcccagaacaacccccccgtgccccccaagccccagcccaaggtgcaggagaaggccgacatccccgtgaagagcagcccccaggccgccgtgccctacaagaaggacgtgggcaagaccctgtgccccctgtgcttcagcatcctgaagggccccatcagcgacgccctggcccaccacctgagagagagacaccaggtgatccagaccgtgcaccccgtggagaagaagctgacctacaagtgcatccactgcctgggcgtgtacaccagcaacatgaccgccagcaccatcaccctgcacctggtgcactgcagaggcgtgggcaagacccagaacggccaggacaagaccaacgcccccagcagactgaaccagagccccagcctggcccccgtgaagagaacctacgagcagatggagttccccctgctgaagaagagaaagctggacgacgacagcgacagccccagcttcttcgaggagaagcccgaggagcccgtggtgctggccctggaccccaagggccacgaggacgacagctacgaggccagaaagagcttcctgaccaagtacttcaacaagcagccctaccccaccagaagagagatcgagaagctggccgccagcctgtggctgtggaagagcgacatcgccagccacttcagcaacaagagaaagaagtgcgtgagagactgcgagaagtacaagcccggcgtgctgctgggcttcaacatgaaggagctgaacaaggtgaagcacgagatggacttcgacgccgagtggctgttcgagaaccacgacgagaaggacagcagagtgaacgccagcaagaccgccgacaagaagctgaacctgggcaaggaggacgacagcagcagcgacagcttcgagaacctggaggaggagagcaacgagagcggcagccccttcgaccccgtgttcgaggtggagcccaagatcagcaacgacaaccccgaggagcacgtgctgaaggtgatccccgaggacgccagcgagagcgaggagaagctggaccagaaggaggacggcagcaagtacgagaccatccacctgaccgaggagcccaccaagctgatgcacaacgccagcgacagcgaggtggaccaggacgacgtggtggagtggaaggacggcgccagccccagcgagagcggccccggcagccagcaggtgagcgacttcgaggacaacacctgcgagatgaagcccggcacctggagcgacgagagcagccagagcgaggacgccagaagcagcaagcccgccgccaagaagaaggccaccatgcagggcgacagagagcagctgaagtggaagaacagcagctacggcaaggtggagggcttctggagcaaggaccagagccagtggaagaacgccagcgagaacgacgagagactgagcaacccccagatcgagtggcagaacagcaccatcgacagcgaggacggcgagcagttcgacaacatgaccgacggcgtggccgagcccatgcacggcagcctggccggcgtgaagctgagcagccagcaggcctag

SEQ ID NO: 1679 - DNA, 3309 bp, Artificial Sequence; identical to SEQ ID NO: 1678
  Description of Artificial Sequence: Synthetic coding sequence

SEQ ID NO: 1680 - DNA, 3309 bp, Artificial Sequence; identical to SEQ ID NO: 1678
  Description of Artificial Sequence: Synthetic coding sequence

SEQ ID NO: 1681 - DNA, 3309 bp, Artificial Sequence; identical to SEQ ID NO: 1678
  Description of Artificial Sequence: Synthetic coding sequence

SEQ ID NO: 1682 - DNA, 522 bp, Artificial Sequence
  Description of Artificial Sequence: Synthetic coding sequence
atgttccagctgcccgtgaacaacctgggcagcctgagaaaggccagaaagaccgtgaagaagatcctgagcgacatcggcctggagtactgcaaggagcacatcgaggacttcaagcagttcgagcccaacgacttctacctgaagaacaccacctgggaggacgtgggcctgtgggaccccagcctgaccaagaaccaggactacagaaccaagcccttctgctgcagcgcctgccccttcagcagcaagttcttcagcgcctacaagagccacttcagaaacgtgcacagcgaggacttcgagaacagaatcctgctgaactgcccctactgcaccttcaacgccgacaagaagaccctggagacccacatcaagatcttccacgcccccaacgccagcgcccccagcagcagcctgagcaccttcaaggacaagaacaagaacgacggcctgaagcccaagcaggccgacagcgtggagcaggccgtgtactactgcaagaagtgcacctacagatag

SEQ ID NO: 1683 - DNA, 441 bp, Artificial Sequence
  Description of Artificial Sequence: Synthetic coding sequence
atggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcaccagattcgacctggagctgcccgacggcaacagacaggtgagaggcgtgacccagctgggcggcgcctgcagccccacctggagctgcctgatcaccgaggacaccggcttcgacctgggcgtgaccatcgcccacgagatcggccacagaatctgcgccagacccagccccgccacccagaccagatggaccaaggccgccgccgccgccagcagcttcctgagctggatgggccagaacgtggcctggagaagcggcgcccccagagtggccgccgccccctggtggagctag

SEQ ID NO: 1684 - DNA, 4116 bp, Artificial Sequence
  Description of Artificial Sequence: Synthetic coding sequence
atgcaccagagacaccccagagccagatgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggcagaccccccagccccggcttccagagacagagacagagacagagaagagccgccggcggcatcctgcacctggagctgctggtggccgtgggccccgacgtgttccaggcccaccaggaggacaccgagagatacgtgctgaccaacctgaacatcggcgccgagctgctgagagaccccagcctgggcgcccagttcagagtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcaccagattcgacctggagctgcccgacggcaacagacaggtgagaggcgtgacccagctgggcggcgcctgcagccccacctggagctgcctgatcaccgaggacaccggcttcgacctgggcgtgaccatcgcccacgagatcggccacagcttcggcctggagcacgacggcgcccccggcagcggctgcggccccagcggccacgtgatggccagcgacggcgccgcccccagagccggcctggcctggagcccctgcagcagaagacagctgctgagcctgctgagcgccggcagagccagatgcgtgtgggacccccccagaccccagcccggcagcgccggccacccccccgacgcccagcccggcctgtactacagcgccaacgagcagtgcagagtggccttcggccccaaggccgtggcctgcaccttcgccagagagcacctggacatgtgccaggccctgagctgccacaccgaccccctggaccagagcagctgcagcagactgctggtgcccctgctggacggcaccgagtgcggcgtggagaagtggtgcagcaagggcagatgcagaagcctggtggagctgacccccatcgccgccgtgcacggcagatggagcagctggggccccagaagcccctgcagcagaagctgcggcggcggcgtggtgaccagaagaagacagtgcaacaaccccagacccgccttcggcggcagagcctgcgtgggcgccgacctgcaggccgagatgtgcaacacccaggcctgcgagaagacccagctggagttcatgagccagcagtgcgccagaaccgacggccagcccctgagaagcagccccggcggcgccagcttctaccactggggcgccgccgtgccccacagccagggcgacgccctgtgcagacacatgtgcagagccatcggcgagagcttcatcatgaagagaggcgacagcttcctggacggcaccagatgcatgcccagcggccccagagaggacggcaccctgagcctgtgcgtgagcggcagctgcagaaccttcggctgcgacggcagaatggacagccagcaggtgtgggacagatgccaggtgtgcggcggcgacaacagcacctgcagccccagaaagggcagcttcaccgccggcagagccagagagtacgtgaccttcctgaccgtgacccccaacctgaccagcgtgtacatcgccaaccacagacccctgttcacccacctggccgtgagaatcggcggcagatacgtggtggccggcaagatgagcatcagccccaacaccacctaccccagcctgctggaggacggcagagtggagtacagagtggccctgaccgaggacagactgcccagactggaggagatcagaatctggggccccctgcaggaggacgccgacatccaggtgtacagaagatacggcgaggagtacggcaacctgaccagacccgacatcaccttcacctacttccagcccaagcccagacaggcctgggtgtgggccgccgtgagaggcccctgcagcgtgagctgcggcgccggcctgagatgggtgaactacagctgcctggaccaggccagaaaggagctggtggagaccgtgcagtgccagggcagccagcagccccccgcctggcccgaggcctgcgtgctggagccctgccccccctactgggccgtgggcgacttcggcccctgcagcgccagctgcggcggcggcctgagagagagacccgtgagatgcgtggaggcccagggcagcctgctgaagaccctgccccccgccagatgcagagccggcgcccagcagcccgccgtggccctggagacctgcaacccccagccctgccccgccagatgggaggtgagcgagcccagcagctgcaccagcgccggcggcgccggcctggccctggagaacgagacctgcgtgcccggcgccgacggcctggaggcccccgtgaccgagggccccggcagcgtggacgagaagctgcccgcccccgagccctgcgtgggcatgagctgcccccccggctggggccacctggacgccaccagcgccggcgagaaggcccccagcccctggggcagcatcagaaccggcgcccaggccgcccacgtgtggacccccgccgccggcagctgcagcgtgagctgcggcagaggcctgatggagctgagattcctgtgcatggacagcgccctgagagtgcccgtgcaggaggagctgtgcggcctggccagcaagcccggcagcagaagagaggtgtgccaggccgtgccctgccccgccagatggcagtacaagctggccgcctgcagcgtgagctgcggcagaggcgtggtgagaagaatcctgtactgcgccagagcccacggcgaggacgacggcgaggagatcctgctggacacccagtgccagggcctgcccagacccgagccccaggaggcctgcagcctggagccctgcccccccagatggaaggtgatgagcctgggcccctgcagcgccagctgcggcctgggcaccgccagaagaagcgtggcctgcgtgcagctggaccagggccaggacgtggaggtggacgaggccgcctgcgccgccctggtgagacccgaggccagcgtgccctgcctgatcgccgactgcacctacagatggcacgtgggcacctggatggagtgcagcgtgagctgcggcgacggcatccagagaagaagagacacctgcctgggcccccaggcccaggcccccgtgcccgccgacttctgccagcacctgcccaagcccgtgaccgtgagaggctgctgggccggcccctgcgtgggccagggcgcctgcggcagacagcacctggagcccaccggcaccatcgacatgagaggccccggccaggccgactgcgccgtggccatcggcagacccctgggcgaggtggtgaccctgagagtgctggagagcagcctgaactgcagcgccggcgacatgctgctgctgtggggcagactgacctggagaaagatgtgcagaaagctgctggacatgaccttcagcagcaagaccaacaccctggtggtgagacagagatgcggcagacccggcggcggcgtgctgctgagatacggcagccagctggcccccgagaccttctacagagagtgcgacatgcagctgttcggcccctggggcgagatcgtgagccccagcctgagccccgccaccagcaacgccggcggctgcagactgttcatcaacgtggccccccacgccagaatcgccatccacgccctggccaccaacatgggcgccggcaccgagggcgccaacgccagctacatcctgatcagagacacccacagcctgagaaccaccgccttccacggccagcaggtgctgtactgggagagcgagagcagccaggccgagatggagttcagcgagggcttcctgaaggcccaggccagcctgagaggccagtactggaccctgcagagctgggtgcccgagatgcaggacccccagagctggaagggcaaggagggcacctag

SEQ ID NO: 1685 - DNA, 4023 bp, Artificial Sequence
  Description of Artificial Sequence: Synthetic coding sequence
atgcaccagagacaccccagagccagatgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggcagaccccccagccccggcttccagagacagagacagagacagagaagagccgccggcggcatcctgcacctggagctgctggtggccgtgggccccgacgtgttccaggcccaccaggaggacaccgagagatacgtgctgaccaacctgaacatcggcgccgagctgctgagagaccccagcctgggcgcccagttcagagtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcaccagattcgacctggagctgcccgacggcaacagacaggtgagaggcgtgacccagctgggcggcgcctgcagccccacctggagctgcctgatcaccgaggacaccggcttcgacctgggcgtgaccatcgcccacgagatcggccacagcttcggcctggagcacgacggcgcccccggcagcggctgcggccccagcggccacgtgatggccagcgacggcgccgcccccagagccggcctggcctggagcccctgcagcagaagacagctgctgagcctgctgagcgccaacgagcagtgcagagtggccttcggccccaaggccgtggcctgcaccttcgccagagagcacctggacatgtgccaggccctgagctgccacaccgaccccctggaccagagcagctgcagcagactgctggtgcccctgctggacggcaccgagtgcggcgtggagaagtggtgcagcaagggcagatgcagaagcctggtggagctgacccccatcgccgccgtgcacggcagatggagcagctggggccccagaagcccctgcagcagaagctgcggcggcggcgtggtgaccagaagaagacagtgcaacaaccccagacccgccttcggcggcagagcctgcgtgggcgccgacctgcaggccgagatgtgcaacacccaggcctgcgagaagacccagctggagttcatgagccagcagtgcgccagaaccgacggccagcccctgagaagcagccccggcggcgccagcttctaccactggggcgccgccgtgccccacagccagggcgacgccctgtgcagacacatgtgcagagccatcggcgagagcttcatcatgaagagaggcgacagcttcctggacggcaccagatgcatgcccagcggccccagagaggacggcaccctgagcctgtgcgtgagcggcagctgcagaaccttcggctgcgacggcagaatggacagccagcaggtgtgggacagatgccaggtgtgcggcggcgacaacagcacctgcagccccagaaagggcagcttcaccgccggcagagccagagagtacgtgaccttcctgaccgtgacccccaacctgaccagcgtgtacatcgccaaccacagacccctgttcacccacctggccgtgagaatcggcggcagatacgtggtggccggcaagatgagcatcagccccaacaccacctaccccagcctgctggaggacggcagagtggagtacagagtggccctgaccgaggacagactgcccagactggaggagatcagaatctggggccccctgcaggaggacgccgacatccaggtgtacagaagatacggcgaggagtacggcaacctgaccagacccgacatcaccttcacctacttccagcccaagcccagacaggcctgggtgtgggccgccgtgagaggcccctgcagcgtgagctgcggcgccggcctgagatgggtgaactacagctgcctggaccaggccagaaaggagctggtggagaccgtgcagtgccagggcagccagcagccccccgcctggcccgaggcctgcgtgctggagccctgccccccctactgggccgtgggcgacttcggcccctgcagcgccagctgcggcggcggcctgagagagagacccgtgagatgcgtggaggcccagggcagcctgctgaagaccctgccccccgccagatgcagagccggcgcccagcagcccgccgtggccctggagacctgcaacccccagccctgccccgccagatgggaggtgagcgagcccagcagctgcaccagcgccggcggcgccggcctggccctggagaacgagacctgcgtgcccggcgccgacggcctggaggcccccgtgaccgagggccccggcagcgtggacgagaagctgcccgcccccgagccctgcgtgggcatgagctgcccccccggctggggccacctggacgccaccagcgccggcgagaaggcccccagcccctggggcagcatcagaaccggcgcccaggccgcccacgtgtggacccccgccgccggcagctgcagcgtgagctgcggcagaggcctgatggagctgagattcctgtgcatggacagcgccctgagagtgcccgtgcaggaggagctgtgcggcctggccagcaagcccggcagcagaagagaggtgtgccaggccgtgccctgccccgccagatggcagtacaagctggccgcctgcagcgtgagctgcggcagaggcgtggtgagaagaatcctgtactgcgccagagcccacggcgaggacgacggcgaggagatcctgctggacacccagtgccagggcctgcccagacccgagccccaggaggcctgcagcctggagccctgcccccccagatggaaggtgatgagcctgggcccctgcagcgccagctgcggcctgggcaccgccagaagaagcgtggcctgcgtgcagctggaccagggccaggacgtggaggtggacgaggccgcctgcgccgccctggtgagacccgaggccagcgtgccctgcctgatcgccgactgcacctacagatggcacgtgggcacctggatggagtgcagcgtgagctgcggcgacggcatccagagaagaagagacacctgcctgggcccccaggcccaggcccccgtgcccgccgacttctgccagcacctgcccaagcccgtgaccgtgagaggctgctgggccggcccctgcgtgggccagggcgcctgcggcagacagcacctggagcccaccggcaccatcgacatgagaggccccggccaggccgactgcgccgtggccatcggcagacccctgggcgaggtggtgaccctgagagtgctggagagcagcctgaactgcagcgccggcgacatgctgctgctgtggggcagactgacctggagaaagatgtgcagaaagctgctggacatgaccttcagcagcaagaccaacaccctggtggtgagacagagatgcggcagacccggcggcggcgtgctgctgagatacggcagccagctggcccccgagaccttctacagagagtgcgacatgcagctgttcggcccctggggcgagatcgtgagccccagcctgagccccgccaccagcaacgccggcggctgcagactgttcatcaacgtggccccccacgccagaatcgccatccacgccctggccaccaacatgggcgccggcaccgagggcgccaacgccagctacatcctgatcagagacacccacagcctgagaaccaccgccttccacggccagcaggtgctgtactgggagagcgagagcagccaggccgagatggagttcagcgagggcttcctgaaggcccaggccagcctgagaggccagtactggaccctgcagagctgggtgcccgagatgcaggacccccagagctggaagggcaaggagggcacctag

SEQ ID NO: 1686 - DNA, 672 bp, Artificial Sequence
  Description of Artificial Sequence: Synthetic coding sequence
atgagaggccccggccaggccgactgcgccgtggccatcggcagacccctgggcgaggtggtgaccctgagagtgctggagagcagcctgaactgcagcgccggcgacatgctgctgctgtggggcagactgacctggagaaagatgtgcagaaagctgctggacatgaccttcagcagcaagaccaacaccctggtggtgagacagagatgcggcagacccggcggcggcgtgctgctgagatacggcagccagctggcccccgagaccttctacagagagtgcgacatgcagctgttcggcccctggggcgagatcgtgagccccagcctgagccccgccaccagcaacgccggcggctgcagactgttcatcaacgtggccccccacgccagaatcgccatccacgccctggccaccaacatgggcgccggcaccgagggcgccaacgccagctacatcctgatcagagacacccacagcctgagaaccaccgccttccacggccagcaggtgctgtactgggagagcgagagcagccaggccgagatggagttcagcgagggcttcctgaaggcccaggccagcctgagaggccagtactggaccctgcagagctgggtgcccgagatgcaggacccccagagctggaagggcaaggagggcacctag

SEQ ID NO: 1687 - DNA, 1035 bp, Artificial Sequence
  Description of Artificial Sequence: Synthetic coding sequence
atgcaccagagacaccccagagccagatgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggcagaccccccagccccggcttccagagacagagacagagacagagaagagccgccggcggcatcctgcacctggagctgctggtggccgtgggccccgacgtgttccaggcccaccaggaggacaccgagagatacgtgctgaccaacctgaacatcggcgccgagctgctgagagaccccagcctgggcgcccagttcagagtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcaccagattcgacctggagctgcccgacggcaacagacaggtgagaggcgtgacccagctgggcggcgcctgcagccccacctggagctgcctgatcaccgaggacaccggcttcgacctgggcgtgaccatcgcccacgagatcggccacagcttcggcctggagcacgacggcgcccccggcagcggctgcggccccagcggccacgtgatggccagcgacggcgccgcccccagagccggcctggcctggagcccctgcagcagaagacagctgctgagcctgctgagacccgtgccccccagccccctgcccctgctggccacccacctgtgcgccggcagaagcctgagcctgggccccagccaggagcccgcccccggcggcggcagaggccccagaacccccgtgcccacccacaagagacccagattccagaccctgcccagcagctgccccctgctgagacccgccagcagcagatgcacccccagagactag

SEQ ID NO: 1688 - DNA, 831 bp, Artificial Sequence
  Description of Artificial Sequence: Synthetic coding sequence
atgcaccagagacaccccagagccagatgcccccccctgtgcgtggccggcatcctggcctgcggcttcctgctgggctgctggggccccagccacttccagcagagctgcctgcaggccctggagccccaggccgtgagcagctacctgagccccggcgcccccctgaagggcagaccccccagccccggcttccagagacagagacagagacagagaagagccgccggcggcatcctgcacctggagctgctggtggccgtgggccccgacgtgttccaggcccaccaggaggacaccgagagatacgtgctgaccaacctgaacatcggcgccgagctgctgagagaccccagcctgggcgcccagttcagagtgcacctggtgaagatggtgatcctgaccgagcccgagggcgcccccaacatcaccgccaacctgaccagcagcctgctgagcgtgtgcggctggagccagaccatcaaccccgaggacgacaccgaccccggccacgccgacctggtgctgtacatcaccagattcgacctggagctgcccgacggcaacagacaggtgagaggcgtgacccagctgggcggcgcctgcagccccacctggagctgcctgatcaccgaggacaccggcttcgacctgggcgtgaccatcgcccacgagatcggccacagaatctgcgccagacccagccccgccacccagaccagatggaccaaggccgccgccgccgccagcagcttcctgagctggatgggccagaacgtggcctggagaagcggcgcccccagagtggccgccgccccctggtggagctag

SEQ ID NO: 1689 - DNA, 4284 bp, Artificial Sequence; identical to SEQ ID NO: 1677
  Description of Artificial Sequence: Synthetic coding sequence

SEQ ID NO: 1690 - DNA, 1095 bp, Artificial Sequence
  Description of Artificial Sequence: Synthetic coding sequence
atggacatgtgccaggccctgagctgccacaccgaccccctggaccagagcagctgcagcagactgctggtgcccctgctggacggcaccgagtgcggcgtggagaagtggtgcagcaagggcagatgcagaagcctggtggagctgacccccatcgccgccgtgcacggcagatggagcagctggggccccagaagcccctgcagcagaagctgcggcggcggcgtggtgaccagaagaagacagtgcaacaaccccagacccgccttcggcggcagagcctgcgtgggcgccgacctgcaggccgagatgtgcaacacccaggcctgcgagaagacccagctggagttcatgagccagcagtgcgccagaaccgacggccagcccctgagaagcagccccggcggcgccagcttctaccactggggcgccgccgtgccccacagccagggcgacgccctgtgcagacacatgtgcagagccatcggcgagagcttcatcatgaagagaggcgacagcttcctggacggcaccagatgcatgcccagcggccccagagaggacggcaccctgagcctgtgcgtgagcggcagctgcagaaccttcggctgcgacggcagaatggacagccagcaggtgtgggacagatgccaggtgtgcggcggcgacaacagcacctgcagccccagaaagggcagcttcaccgccggcagagccagagagtacgtgaccttcctgaccgtgacccccaacctgaccagcgtgtacatcgccaaccacagacccctgttcacccacctggccgtgagaatcggcggcagatacgtggtggccggcaagatgagcatcagccccaacaccacctaccccagcctgctggaggacggcagagtggagtacagagtggccctgaccgaggacagactgcccagactggaggagatcagaatctggggccccctgcaggaggacgccgacatccaggtgggcggcgtgagagcccagctgatgcacatcagctggtggagcagacccggcctgggcgagagagacctgtgcgccagaggcagatggcccggcggcagcagcgactag

SEQ ID NO: 1691 - DNA, 1095 bp, Artificial Sequence
  Description of Artificial Sequence: Synthetic coding sequence
atgccctaccagtaccccgccctgacccccgagcagaagaaggagctgagcgacatcgcccacagaatcgtggcccccggcaagggcatcctggccgccgacgagagcaccggcagcatcgccaagagactgcagagcatcggcaccgagaacaccgaggagaacagaagattctacagacagctgctgctgaccgccgacgacagagtgaacccctgcatcggcggcgtgatcctgttccacgagaccctgtaccagaaggccgacgacggcagacccttcccccaggtgatcaagagcaagggcggcgtggtgggcatcaaggtggacaagggcgtggtgcccctggccggcaccaacggcgagaccaccacccagggcctggacggcctgagcgagagatgcgcccagtacaagaaggacggcgccgacttcgccaagtggagatgcgtgctgaagatcggcgagcacacccccagcgccctggccatcatggagaacgccaacgtgctggccagatacgccagcatctgccagcagaacggcatcgtgcccatcgtggagcccgagatcctgcccgacggcgaccacgacctgaagagatgccagtacgtgaccgagaaggtgctggccgccgtgtacaaggccctgagcgaccaccacatctacctggagggcaccctgctgaagcccaacatggtgacccccggccacgcctgcacccagaagttcagccacgaggagatcgccatggccaccgtgaccgccctgagaagaaccgtgccccccgccgtgaccggcatcaccttcctgagcggcggccagagcgaggaggaggccagcatcaacctgaacgccatcaacaagtgccccctgctgaagccctgggccctgaccttcagctacggcagagccctgcaggccagcgccctgaaggcctggggcggcaagaaggagaacctgaaggccgcccaggaggagtacgtgaagagagccctggccaacagcctggcctgccagggcaagtacacccccagcggccaggccggcgccgccgccagcgagagcctgttcgtgagcaaccacgcctactag

SEQ ID NO: 1692 - DNA, 1095 bp, Artificial Sequence; identical to SEQ ID NO: 1691
  Description of Artificial Sequence: Synthetic coding sequence

SEQ ID NO: 1693 - DNA, 1257 bp, Artificial Sequence
  Description of Artificial Sequence: Synthetic coding sequence
atggccagaagaaagcccgagggcagcagcttcaacatgacccacctgagcatggccatggccttcagcttcccccccgtggccagcggccagctgcacccccagctgggcaacacccagcaccagaccgagctgggcaaggagctggccaccaccagcaccatgccctaccagtaccccgccctgacccccgagcagaagaaggagctgagcgacatcgcccacagaatcgtggcccccggcaagggcatcctggccgccgacgagagcaccggcagcatcgccaagagactgcagagcatcggcaccgagaacaccgaggagaacagaagattctacagacagctgctgctgaccgccgacgacagagtgaacccctgcatcggcggcgtgatcctgttccacgagaccctgtaccagaaggccgacgacggcagacccttcccccaggtgatcaagagcaagggcggcgtggtgggcatcaaggtggacaagggcgtggtgcccctggccggcaccaacggcgagaccaccacccagggcctggacggcctgagcgagagatgcgcccagtacaagaaggacggcgccgacttcgccaagtggagatgcgtgctgaagatcggcgagcacacccccagcgccctggccatcatggagaacgccaacgtgctggccagatacgccagcatctgccagcagaacggcatcgtgcccatcgtggagcccgagatcctgcccgacggcgaccacgacctgaagagatgccagtacgtgaccgagaaggtgctggccgccgtgtacaaggccctgagcgaccaccacatctacctggagggcaccctgctgaagcccaacatggtgacccccggccacgcctgcacccagaagttcagccacgaggagatcgccatggccaccgtgaccgccctgagaagaaccgtgccccccgccgtgaccggcatcaccttcctgagcggcggccagagcgaggaggaggccagcatcaacctgaacgccatcaacaagtgccccctgctgaagccctgggccctgaccttcagctacggcagagccctgcaggccagcgccctgaaggcctggggcggcaagaaggagaacctgaaggccgcccaggaggagtacgtgaagagagccctggccaacagcctggcctgccagggcaagtacacccccagcggccaggccggcgccgccgccagcgagagcctgttcgtgagcaaccacgcctactag

SEQ ID NO: 1694 - DNA, 1095 bp, Artificial Sequence; identical to SEQ ID NO: 1691
  Description of Artificial Sequence: Synthetic coding sequence

SEQ ID NO: 1695 - DNA, 1095 bp, Artificial Sequence; identical to SEQ ID NO: 1691
  Description of Artificial Sequence: Synthetic coding sequence

SEQ ID NO: 1696 - DNA, 1257 bp, Artificial Sequence; identical to SEQ ID NO: 1693
  Description of Artificial Sequence: Synthetic coding sequence

SEQ ID NO: 1697 - DNA, 1095 bp, Artificial Sequence; identical to SEQ ID NO: 1691
  Description of Artificial Sequence: Synthetic coding sequence

SEQ ID NO: 1698 - DNA, 1344 bp, Artificial Sequence
  Description of Artificial Sequence: Synthetic coding sequence
atgagcgccagcaagatccccctgttcaagatgaaggacctgatcctgatcctgtgcctgctggagatgagcttcgccgtgcccttcttcccccagcagagcggcacccccggcatggccagcctgagcctggagaccatgagacagctgggcagcctgcagagactgaacaccctgagccagtacagcagatacggcttcggcaagagcttcaacagcctgtggatgcacggcctgctgcccccccacagcagcctgccctggatgagacccagagagcacgagacccagcagtacgagtacagcctgcccgtgcaccccccccccctgcccagccagcccagcctgaagccccagcagcccggcctgaagcccttcctgcagagcgccgccgccaccaccaaccaggccaccgccctgaaggaggccctgcagccccccatccacctgggccacctgcccctgcaggagggcgagctgcccctggtgcagcagcaggtggcccccagcgacaagccccccaagcccgagctgcccggcgtggacttcgccgacccccagggccccagcctgcccggcatggacttccccgacccccagggccccagcctgcccggcctggacttcgccgacccccagggcagcaccatcttccagatcgccagactgatcagccacggccccatgccccagaacaagcagagccccctgtaccccggcatgctgtacgtgcccttcggcgccaaccagctgaacgcccccgccagactgggcatcatgagcagcgaggaggtggccggcggcagagaggaccccatggcctacggcgccatgttccccggcttcggcggcatgagacccggcttcgagggcatgccccacaaccccgccatgggcggcgacttcaccctggagttcgacagccccgtggccgccaccaagggccccgagaacgaggagggcggcgcccagggcagccccatgcccgaggccaaccccgacaacctggagaaccccgccttcctgaccgagctggagcccgccccccacgccggcctgctggccctgcccaaggacgacatccccggcctgcccagaagccccagcggcaagatgaagggcctgcccagcgtgacccccgccgccgccgaccccctgatgacccccgagctggccgacgtgtacagaacctacgacgccgacatgaccaccagcgtggacttccaggaggaggccaccatggacaccaccatggcccccaacagcctgcagaccagcatgcccggcaacaaggcccaggagcccgagatgatgcacgacgcctggcacttccaggagccctag

SEQ ID NO: 1699 - DNA, 1299 bp, Artificial Sequence
  Description of Artificial Sequence: Synthetic coding sequence
atgagcgccagcaagatccccctgttcaagatgaaggacctgatcctgatcctgtgcctgctggagatgagcttcgccgtgcccttcttcccccagcagagcggcacccccggcatggccagcctgagcctggagaccatgagacagctgggcagcctgcagagactgaacaccctgagccagtacagcagatacggcttcggcaagagcttcaacagcctgtggatgcacggcctgctgcccccccacagcagcctgccctggatgagacccagagagcacgagacccagcagcccagcctgaagccccagcagcccggcctgaagcccttcctgcagagcgccgccgccaccaccaaccaggccaccgccctgaaggaggccctgcagccccccatccacctgggccacctgcccctgcaggagggcgagctgcccctggtgcagcagcaggtggcccccagcgacaagccccccaagcccgagctgcccggcgtggacttcgccgacccccagggccccagcctgcccggcatggacttccccgacccccagggccccagcctgcccggcctggacttcgccgacccccagggcagcaccatcttccagatcgccagactgatcagccacggccccatgccccagaacaagcagagccccctgtaccccggcatgctgtacgtgcccttcggcgccaaccagctgaacgcccccgccagactgggcatcatgagcagcgaggaggtggccggcggcagagaggaccccatggcctacggcgccatgttccccggcttcggcggcatgagacccggcttcgagggcatgccccacaaccccgccatgggcggcgacttcaccctggagttcgacagccccgtggccgccaccaagggccccgagaacgaggagggcggcgcccagggcagccccatgcccgaggccaaccccgacaacctggagaaccccgccttcctgaccgagctggagcccgccccccacgccggcctgctggccctgcccaaggacgacatccccggcctgcccagaagccccagcggcaagatgaagggcctgcccagcgtgacccccgccgccgccgaccccctgatgacccccgagctggccgacgtgtacagaacctacgacgccgacatgaccaccagcgtggacttccaggaggaggccaccatggacaccaccatggcccccaacagcctgcagaccagcatgcccggcaacaaggcccaggagcccgagatgatgcacgacgcctggcacttccaggagccctag

SEQ ID NO: 1700 - DNA, 1341 bp, Artificial Sequence
  Description of Artificial Sequence: Synthetic coding sequence
atgagcgccagcaagatccccctgttcaagatgaaggacctgatcctgatcctgtgcctgctggagatgagcttcgccgtgcccttcttcccccagcagagcggcacccccggcatggccagcctgagcctggagaccatgagacagctgggcagcctgcagagactgaacaccctgagccagtacagcagatacggcttcggcaagagcttcaacagcctgtggatgcacggcctgctgcccccccacagcagcctgccctggatgagacccagagagcacgagacccagcagtacgagtacagcctgcccgtgcaccccccccccctgcccagccagcccagcctgaagccccagcagcccggcctgaagcccttcctgcagagcgccgccgccaccaccaaccaggccaccgccctgaaggaggccctgcagccccccatccacctgggccacctgcccctgcaggagggcgagctgcccctggtgcagcagcaggtggcccccagcgacaagccccccaagcccgagctgagagtggacttcgccgacccccagggccccagcctgcccggcatggacttccccgacccccagggccccagcctgcccggcctggacttcgccgacccccagggcagcaccatcttccagatcgccagactgatcagccacggccccatgccccagaacaagcagagccccctgtaccccggcatgctgtacgtgcccttcggcgccaaccagctgaacgcccccgccagactgggcatcatgagcagcgaggaggtggccggcggcagagaggaccccatggcctacggcgccatgttccccggcttcggcggcatgagacccggcttcgagggcatgccccacaaccccgccatgggcggcgacttcaccctggagttcgacagccccgtggccgccaccaagggccccgagaacgaggagggcggcgcccagggcagccccatgcccgaggccaaccccgacaacctggagaaccccgccttcctgaccgagctggagcccgccccccacgccggcctgctggccctgcccaaggacgacatccccggcctgcccagaagccccagcggcaagatgaagggcctgcccagcgtgacccccgccgccgccgaccccctgatgacccccgagctggccgacgtgtacagaacctacgacgccgacatgaccaccagcgtggacttccaggaggaggccaccatggacaccaccatggcccccaacagcctgcagaccagcatgcccggcaacaaggcccaggagcccgagatgatgcacgacgcctggcacttccaggagccctag

SEQ ID NO: 1701 - DNA, 528 bp, Artificial Sequence
  Description of Artificial Sequence: Synthetic coding sequence
atgggcacctggatcctgttcgcctgcctgctgggcgccgccttcgccatgcccgtgctgacccccctgaagtggtaccagagcatcagacccccctaccccagctacggctacgagcccatgggcggctggctgcaccaccagatcatccccgtgctgagccagcagcacccccccacccacaccctgcagccccaccaccacatccccgtggtgcccgcccagcagcccgtgatcccccagcagcccatgatgcccgtgcccggccagcacagcatgacccccatccagcaccaccagcccaacctgcccccccccgcccagcagccctaccagccccagcccgtgcagccccagccccaccagcccatgcagccccagccccccgtgcaccccatgcagcccctgcccccccagccccccctgccccccatgttccccatgcagcccctgccccccatgctgcccgacctgaccctggaggcctggcccagcaccgacaagaccaagagagaggaggtggactag

SEQ ID NO: 1702 - DNA, 618 bp, Artificial Sequence
  Description of Artificial Sequence: Synthetic coding sequence
atgggcacctggatcctgttcgcctgcctgctgggcgccgccttcgccatgcccctgcccccccaccccggccaccccggctacatcaacttcagctacgagaacagccacagccaggccatcaacgtggacagaaccgccctggtgctgacccccctgaagtggtaccagagcatcagacccccctaccccagctacggctacgagcccatgggcggctggctgcaccaccagatcatccccgtgctgagccagcagcacccccccacccacaccctgcagccccaccaccacatccccgtggtgcccgcccagcagcccgtgatcccccagcagcccatgatgcccgtgcccggccagcacagcatgacccccatccagcaccaccagcccaacctgcccccccccgcccagcagccctaccagccccagcccgtgcagccccagccccaccagcccatgcagccccagccccccgtgcaccccatgcagcccctgcccccccagccccccctgccccccatgttccccatgcagcccctgccccccatgctgcccgacctgaccctggaggcctggcccagcaccgacaagaccaagagagaggaggtggactag

SEQ ID NO: 1703 - DNA, 576 bp, Artificial Sequence
  Description of Artificial Sequence: Synthetic coding sequence
atgggcacctggatcctgttcgcctgcctgctgggcgccgccttcgccatgcccctgcccccccaccccggccaccccggctacatcaacttcagctacgaggtgctgacccccctgaagtggtaccagagcatcagacccccctaccccagctacggctacgagcccatgggcggctggctgcaccaccagatcatccccgtgctgagccagcagcacccccccacccacaccctgcagccccaccaccacatccccgtggtgcccgcccagcagcccgtgatcccccagcagcccatgatgcccgtgcccggccagcacagcatgacccccatccagcaccaccagcccaacctgcccccccccgcccagcagccctaccagccccagcccgtgcagccccagccccaccagcccatgcagccccagccccccgtgcaccccatgcagcccctgcccccccagccccccctgccccccatgttccccatgcagcccctgccccccatgctgcccgacctgaccctggaggcctggcccagcaccgacaagaccaagagagaggaggtggactag

SEQ ID NO: 1704 - DNA, 4023 bp, Artificial Sequence
  Description of Artificial Sequence: Synthetic coding sequence
atgttcagagtgggcttcctgatcatcagcagcagcagcagcctgagccccctgctgctggtgagcgtggtgagagtgaacaccaccaactgccacaagtgcctgctgagcggcacctacatcttcgccgtgctgctggtgtgcgtggtgttccacagcggcgcccaggagaagaactacaccatcagagaggagatccccgagaacgtgctgatcggcaacctgctgaaggacctgaacctgagcctgatccccaacaagagcctgaccaccaccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaacgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgatgaaggtgagcgccaccgacgccgacagcggccccaacgccgagatcaactacctgctgggccccgacgccccccccgagttcagcctggacagaagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaagttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgcccccctacaactacagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcatcgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacatgcagaacagcgagtgggccacccccaaccccgagaacagacagatgatcatgatgaagaagaagaagaagaagaagaagcacagccccaagaacctgctgctgaacgtggtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacctgaagcaccacatcatccaggagctgcccctggacaacaccttcgtggcctgcgacagcatcagcaactgcagcagcagcagcagcgacccctacagcgtgagcgactgcggctaccccgtgaccaccttcgaggtgcccgtgagcgtgcacaccagacccagccagagaagagtgaccttccacctgcccgagggcagccaggagagcagcagcgacggcggcctgggcgaccacgacgccggcagcctgaccagcaccagccacggcctgcccctgggctacccccaggaggagtacttcgacagagccacccccagcaacagaaccgagggcgacggcaacagcgaccccgagagcaacttcatcagcggcatgagagagaagatcaccgtgcagcccaccgtggaggaggccagcgacaactgcacccaggagtgcctgatctacggccacagcgacgcctgctggatgcccgccagcctggaccacagcagcagcagccaggcccaggccagcgccctgtgccacagcccccccctgagccaggccagcacccagcaccacagcccccccgtgacccagaccatcgtgctgtgccacagcccccccgtgacccagaccatcgccctgtgccacagccccccccccatccaggtgagcgccctgcaccacagcccccccctggtgcagggcaccgccctgcaccacagcccccccagcgcccaggccagcgccctgtgctacagcccccccctggcccaggccgccgccatcagccacagcagcagcctgccccaggtgatcgccctgcacagaagccaggcccagagcagcgtgagcctgcagcagggctgggtgcagggcgccaacggcctgtgcagcgtggaccagggcgtgcagggcagcgccaccagccagttctacaccatgagcgagagactgcaccccagcgacgacagcatcaaggtgatccccctgaccaccttcgcccccagacagcaggccagacccagcagaggcgacagccccatcatggagacccaccccctgtag

SEQ ID NO: 1705 - DNA, 621 bp, Artificial Sequence
  Description of Artificial Sequence: Synthetic coding sequence
atgggcacctggatcctgttcgcctgcctggtgggcgccgccttcgccatgcccctgcccccccaccccggccaccccggctacatcaacttcagctacgagaacagccacagccaggccatcaacgtggacagaatcgccctggtgctgacccccctgaagtggtaccagagcatgatcagacccccctacagcagctacggctacgagcccatgggcggctggctgcaccaccagatcatccccgtggtgagccagcagcaccccctgacccacaccctgcagagccaccaccacatccccgtggtgcccgcccagcagcccagagtgagacagcaggccctgatgcccgtgcccggccagcagagcatgacccccacccagcaccaccagcccaacctgcccctgcccgcccagcagcccttccagccccagcccgtgcagccccagccccaccagcccatgcagccccagccccccgtgcagcccatgcagcccctgctgccccagccccccctgccccccatgttccccctgagacccctgccccccatcctgcccgacctgcacctggaggcctggcccgccaccgacaagaccaagcaggaggaggtggactag

SEQ ID NO: 1706 - DNA, 618 bp, Artificial Sequence
  Description of Artificial Sequence: Synthetic coding sequence
atgggcacctggatcctgttcgcctgcctggtgggcgccgccttcgccatgcccctgcccccccaccccggccaccccggctacatcaacttcagctacgagaacagccacagccaggccatcaacgtggacagaatcgccctggtgctgacccccctgaagtggtaccagagcatgatcagacccccctacagcagctacggctacgagcccatgggcggctggctgcaccaccagatcatccccgtggtgagccagcagcaccccctgacccacaccctgcagagccaccaccacatccccgtggtgcccgcccagcagcccagagtgagacagcaggccctgatgcccgtgcccggccagcagagcatgacccccacccagcaccaccagcccaacctgcccctgcccgcccagcagcccttccagccccagcccgtgcagccccagccccaccagcccatgcagccccagccccccgtgcagcccatgcagcccctgctgccccagccccccctgccccccatgttccccctgagacccctgccccccatcctgcccgacctgcacctggaggcctggcccgccaccgacaagaccaagcaggaggaggtgtag

SEQ ID NO: 1707 - DNA, 4599 bp, Artificial Sequence
  Description of Artificial Sequence: Synthetic coding sequence
atgggccacagcaagcagatcagaatcctgctgctgaacgagatggagaagctggagaagaccctgttcagactggagcagggctacgagctgcagttcagactgggccccaccctgcagggcaaggccgtgaccgtgtacaccaactaccccttccccggcgagaccttcaacagagagaagttcagaagcctggactgggagaaccccaccgagagagaggacgacagcgacaagtactgcaagctgaacctgcagcagagcggcagcttccagtactacttcctgcagggcaacgagaagagcggcggcggctacatcgtggtggaccccatcctgagagtgggcgccgacaaccacgtgctgcccctggactgcgtgaccctgcagaccttcctggccaagtgcctgggccccttcgacgagtgggagagcagactgagagtggccaaggagagcggctacaacatgatccacttcacccccctgcagaccctgggcctgagcagaagctgctacagcctggccaaccagctggagctgaaccccgacttcagcagacccaacagaaagtacacctggaacgacgtgggccagctggtggagaagctgaagaaggagtggaacgtgatctgcatcaccgacgtggtgtacaaccacaccgccgccaacagcaagtggatccaggagcaccccgagtgcgcctacaacctggtgaacagcccccacctgaagcccgcctgggtgctggacagagccctgtggagattcagctgcgacgtggccgagggcaagtacaaggagaagggcatccccgccctgatcgagaacgaccaccacatgaacagcatcagaaagatcatctgggaggacatcttccccaagctgaagctgtgggagttcttccaggtggacgtgaacaaggccgtggagcagttcagaagactgctgacccaggagaacagaagagtgaccaagagcgaccccaaccagcacctgaccatcatccaggaccccgagtacagaagattcggctgcaccgtggacatgaacatcgccctgaccaccttcatcccccacgacaagggccccgccgccatcgaggagtgctgcaactggttccacaagagaatggaggagctgaacagcgagaagcacagactgatcaactaccaccaggagcaggccgtgaactgcctgctgggcaacgtgttctacgagagactggccggccacggccccaagctgggccccgtgaccagaaagcaccccctggtgaccagatacttcaccttccccttcgaggagatcgacttcagcatggaggagagcatgatccacctgcccaacaaggcctgcttcctgatggcccacaacggctgggtgatgggcgacgaccccctgagaaacttcgccgagcccggcagcgaggtgtacctgagaagagagctgatctgctggggcgacagcgtgaagctgagatacggcaacaagcccgaggactgcccctacctgtgggcccacatgaagaagtacaccgagatcaccgccacctacttccagggcgtgagactggacaactgccacagcacccccctgcacgtggccgagtacatgctggacgccgccagaaacctgcagcccaacctgtacgtggtggccgagctgttcaccggcagcgaggacctggacaacgtgttcgtgaccagactgggcatcagcagcctgatcagagaggccatgagcgcctacaacagccacgaggagggcagactggtgtacagatacggcggcgagcccgtgggcagcttcgtgcagccctgcctgagacccctgatgcccgccatcgcccacgccctgttcatggacatcacccacgacaacgagtgccccatcgtgcacagaagcgcctacgacgccctgcccagcaccaccatcgtgagcatggcctgctgcgccagcggcagcaccagaggctacgacgagctggtgccccaccagatcagcgtggtgagcgaggagagattctacaccaagtggaaccccgaggccctgcccagcaacaccggcgaggtgaacttccagagcggcatcatcgccgccagatgcgccatcagcaagctgcaccaggagctgggcgccaagggcttcatccaggtgtacgtggaccaggtggacgaggacatcgtggccgtgaccagacacagccccagcatccaccagagcgtggtggccgtgagcagaaccgccttcagaaaccccaagaccagcttctacagcaaggaggtgccccagatgtgcatccccggcaagatcgaggaggtggtgctggaggccagaaccatcgagagaaacaccaagccctacagaaaggacgagaacagcatcaacggcacccccgacatcaccgtggagatcagagagcacatccagctgaacgagagcaagatcgtgaagcaggccggcgtggccaccaagggccccaacgagtacatccaggagatcgagttcgagaacctgagccccggcagcgtgatcatcttcagagtgagcctggacccccacgcccaggtggccgtgggcatcctgagaaaccacctgacccagttcagcccccacttcaagagcggcagcctggccgtggacaacgccgaccccatcctgaagatccccttcgccagcctggccagcagactgaccctggccgagctgaaccagatcctgtacagatgcgagagcgaggagaaggaggacggcggcggctgctacgacatccccaactggagcgccctgaagtacgccggcctgcagggcctgatgagcgtgctggccgagatcagacccaagaacgacctgggccaccccttctgcaacaacctgagaagcggcgactggatgatcgactacgtgagcaacagactgatcagcagaagcggcaccatcgccgaggtgggcaagtggctgcaggccatgttcttctacctgaagcagatccccagatacctgatcccctgctacttcgacgccatcctgatcggcgcctacaccaccctgctggacaccgcctggaagcagatgagcagcttcgtgcagaacggcagcaccttcgtgaagcacctgagcctgggcagcgtgcagctgtgcggcgtgggcaagttccccagcctgcccatcctgagccccgccctgatggacgtgccctacagactgaacgagatcaccaaggagaaggagcagtgctgcgtgagcctggccgccggcctgccccacttcagcagcggcatcttcagatgctggggcagagacaccttcatcgccctgagaggcatcctgctgatcaccggcagatacgtggaggccagaaacatcatcctggccttcgccggcaccctgagacacggcctgatccccaacctgctgggcgagggcatctacgccagatacaactgcagagacgccgtgtggtggtggctgcagtgcatccaggactactgcaagatggtgcccaacggcctggacatcctgaagtgccccgtgagcagaatgtaccccaccgacgacagcgcccccctgcccgccggcaccctggaccagcccctgttcgaggtgatccaggaggccatgcagaagcacatgcagggcatccagttcagagagagaaacgccggcccccagatcgacagaaacatgaaggacgagggcttcaacatcaccgccggcgtggacgaggagaccggcttcgtgtacggcggcaacagattcaactgcggcacctggatggacaagatgggcgagagcgacagagccagaaacagaggcatccccgccacccccagagacggcagcgccgtggagatcgtgggcctgagcaagagcgccgtgagatggctgctggagctgagcaagaagaacatcttcccctaccacgaggtgaccgtgaagagacacggcaaggccatcaaggtgagctacgacgagtggaacagaaagatccaggacaacttcgagaagctgttccacgtgagcgaggaccccagcgacctgaacgagaagcaccccaacctggtgcacaagagaggcatctacaaggacagctacggcgccagcagcccctggtgcgactaccagctgagacccaacttcaccatcgccatggtggtggcccccgagctgttcaccaccgagaaggcctggaaggccctggagatcgccgagaagaagctgctgggccccctgggcatgaagaccctggaccccgacgacatggtgtactgcggcatctacgacaacgccctggacaacgacaactacaacctggccaagggcttcaactaccaccagggccccgagtggctgtggcccatcggctacttcctgagagccaagctgtacttcagcagactgatgggccccgagaccaccgccaagaccatcgtgctggtgaagaacgtgctgagcagacactacgtgcacctggagagaagcccctggaagggcctgcccgagctgaccaacgagaacgcccagtactgccccttcagctgcgagacccaggcctggagcatcgccaccatcctggagaccctgtacgacctgtag

SEQ ID NO: 1708 - DNA, 4551 bp, Artificial Sequence
  Description of Artificial Sequence: Synthetic coding sequence
atggcccccatcctgagcatcaacctgttcatcggctacgagctgcagttcagactgggccccaccctgcagggcaaggccgtgaccgtgtacaccaactaccccttccccggcgagaccttcaacagagagaagttcagaagcctggactgggagaaccccaccgagagagaggacgacagcgacaagtactgcaagctgaacctgcagcagagcggcagcttccagtactacttcctgcagggcaacgagaagagcggcggcggctacatcgtggtggaccccatcctgagagtgggcgccgacaaccacgtgctgcccctggactgcgtgaccctgcagaccttcctggccaagtgcctgggccccttcgacgagtgggagagcagactgagagtggccaaggagagcggctacaacatgatccacttcacccccctgcagaccctgggcctgagcagaagctgctacagcctggccaaccagctggagctgaaccccgacttcagcagacccaacagaaagtacacctggaacgacgtgggccagctggtggagaagctgaagaaggagtggaacgtgatctgcatcaccgacgtggtgtacaaccacaccgccgccaacagcaagtggatccaggagcaccccgagtgcgcctacaacctggtgaacagcccccacctgaagcccgcctgggtgctggacagagccctgtggagattcagctgcgacgtggccgagggcaagtacaaggagaagggcatccccgccctgatcgagaacgaccaccacatgaacagcatcagaaagatcatctgggaggacatcttccccaagctgaagctgtgggagttcttccaggtggacgtgaacaaggccgtggagcagttcagaagactgctgacccaggagaacagaagagtgaccaagagcgaccccaaccagcacctgaccatcatccaggaccccgagtacagaagattcggctgcaccgtggacatgaacatcgccctgaccaccttcatcccccacgacaagggccccgccgccatcgaggagtgctgcaactggttccacaagagaatggaggagctgaacagcgagaagcacagactgatcaactaccaccaggagcaggccgtgaactgcctgctgggcaacgtgttctacgagagactggccggccacggccccaagctgggccccgtgaccagaaagcaccccctggtgaccagatacttcaccttccccttcgaggagatcgacttcagcatggaggagagcatgatccacctgcccaacaaggcctgcttcctgatggcccacaacggctgggtgatgggcgacgaccccctgagaaacttcgccgagcccggcagcgaggtgtacctgagaagagagctgatctgctggggcgacagcgtgaagctgagatacggcaacaagcccgaggactgcccctacctgtgggcccacatgaagaagtacaccgagatcaccgccacctacttccagggcgtgagactggacaactgccacagcacccccctgcacgtggccgagtacatgctggacgccgccagaaacctgcagcccaacctgtacgtggtggccgagctgttcaccggcagcgaggacctggacaacgtgttcgtgaccagactgggcatcagcagcctgatcagagaggccatgagcgcctacaacagccacgaggagggcagactggtgtacagatacggcggcgagcccgtgggcagcttcgtgcagccctgcctgagacccctgatgcccgccatcgcccacgccctgttcatggacatcacccacgacaacgagtgccccatcgtgcacagaagcgcctacgacgccctgcccagcaccaccatcgtgagcatggcctgctgcgccagcggcagcaccagaggctacgacgagctggtgccccaccagatcagcgtggtgagcgaggagagattctacaccaagtggaaccccgaggccctgcccagcaacaccggcgaggtgaacttccagagcggcatcatcgccgccagatgcgccatcagcaagctgcaccaggagctgggcgccaagggcttcatccaggtgtacgtggaccaggtggacgaggacatcgtggccgtgaccagacacagccccagcatccaccagagcgtggtggccgtgagcagaaccgccttcagaaaccccaagaccagcttctacagcaaggaggtgccccagatgtgcatccccggcaagatcgaggaggtggtgctggaggccagaaccatcgagagaaacaccaagccctacagaaaggacgagaacagcatcaacggcacccccgacatcaccgtggagatcagagagcacatccagctgaacgagagcaagatcgtgaagcaggccggcgtggccaccaagggccccaacgagtacatccaggagatcgagttcgagaacctgagccccggcagcgtgatcatcttcagagtgagcctggacccccacgcccaggtggccgtgggcatcctgagaaaccacctgacccagttcagcccccacttcaagagcggcagcctggccgtggacaacgccgaccccatcctgaagatccccttcgccagcctggccagcagactgaccctggccgagctgaaccagatcctgtacagatgcgagagcgaggagaaggaggacggcggcggctgctacgacatccccaactggagcgccctgaagtacgccggcctgcagggcctgatgagcgtgctggccgagatcagacccaagaacgacctgggccaccccttctgcaacaacctgagaagcggcgactggatgatcgactacgtgagcaacagactgatcagcagaagcggcaccatcgccgaggtgggcaagtggctgcaggccatgttcttctacctgaagcagatccccagatacctgatcccctgctacttcgacgccatcctgatcggcgcctacaccaccctgctggacaccgcctggaagcagatgagcagcttcgtgcagaacggcagcaccttcgtgaagcacctgagcctgggcagcgtgcagctgtgcggcgtgggcaagttccccagcctgcccatcctgagccccgccctgatggacgtgccctacagactgaacgagatcaccaaggagaaggagcagtgctgcgtgagcctggccgccggcctgccccacttcagcagcggcatcttcagatgctggggcagagacaccttcatcgccctgagaggcatcctgctgatcaccggcagatacgtggaggccagaaacatcatcctggccttcgccggcaccctgagacacggcctgatccccaacctgctgggcgagggcatctacgccagatacaactgcagagacgccgtgtggtggtggctgcagtgcatccaggactactgcaagatggtgcccaacggcctggacatcctgaagtgccccgtgagcagaatgtaccccaccgacgacagcgcccccctgcccgccggcaccctggaccagcccctgttcgaggtgatccaggaggccatgcagaagcacatgcagggcatccagttcagagagagaaacgccggcccccagatcgacagaaacatgaaggacgagggcttcaacatcaccgccggcgtggacgaggagaccggcttcgtgtacggcggcaacagattcaactgcggcacctggatggacaagatgggcgagagcgacagagccagaaacagaggcatccccgccacccccagagacggcagcgccgtggagatcgtgggcctgagcaagagcgccgtgagatggctgctggagctgagcaagaagaacatcttcccctaccacgaggtgaccgtgaagagacacggcaaggccatcaaggtgagctacgacgagtggaacagaaagatccaggacaacttcgagaagctgttccacgtgagcgaggaccccagcgacctgaacgagaagcaccccaacctggtgcacaagagaggcatctacaaggacagctacggcgccagcagcccctggtgcgactaccagctgagacccaacttcaccatcgccatggtggtggcccccgagctgttcaccaccgagaaggcctggaaggccctggagatcgccgagaagaagctgctgggccccctgggcatgaagaccctggaccccgacgacatggtgtactgcggcatctacgacaacgccctggacaacgacaactacaacctggccaagggcttcaactaccaccagggccccgagtggctgtggcccatcggctacttcctgagagccaagctgtacttcagcagactgatgggccccgagaccaccgccaagaccatcgtgctggtgaagaacgtgctgagcagacactacgtgcacctggagagaagcccctggaagggcctgcccgagctgaccaacgagaacgcccagtactgccccttcagctgcgagacccaggcctggagcatcgccaccatcctggagaccctgtacgacctgtag

SEQ ID NO: 1709 - DNA, 4548 bp, Artificial Sequence
  Description of Artificial Sequence: Synthetic coding sequence
atgagcctgctgacctgcgccttctacctgggctacgagctgcagttcagactgggccccaccctgcagggcaaggccgtgaccgtgtacaccaactaccccttccccggcgagaccttcaacagagagaagttcagaagcctggactgggagaaccccaccgagagagaggacgacagcgacaagtactgcaagctgaacctgcagcagagcggcagcttccagtactacttcctgcagggcaacgagaagagcggcggcggctacatcgtggtggaccccatcctgagagtgggcgccgacaaccacgtgctgcccctggactgcgtgaccctgcagaccttcctggccaagtgcctgggccccttcgacgagtgggagagcagactgagagtggccaaggagagcggctacaacatgatccacttcacccccctgcagaccctgggcctgagcagaagctgctacagcctggccaaccagctggagctgaaccccgacttcagcagacccaacagaaagtacacctggaacgacgtgggccagctggtggagaagctgaagaaggagtggaacgtgatctgcatcaccgacgtggtgtacaaccacaccgccgccaacagcaagtggatccaggagcaccccgagtgcgcctacaacctggtgaacagcccccacctgaagcccgcctgggtgctggacagagccctgtggagattcagctgcgacgtggccgagggcaagtacaaggagaagggcatccccgccctgatcgagaacgaccaccacatgaacagcatcagaaagatcatctgggaggacatcttccccaagctgaagctgtgggagttcttccaggtggacgtgaacaaggccgtggagcagttcagaagactgctgacccaggagaacagaagagtgaccaagagcgaccccaaccagcacctgaccatcatccaggaccccgagtacagaagattcggctgcaccgtggacatgaacatcgccctgaccaccttcatcccccacgacaagggccccgccgccatcgaggagtgctgcaactggttccacaagagaatggaggagctgaacagcgagaagcacagactgatcaactaccaccaggagcaggccgtgaactgcctgctgggcaacgtgttctacgagagactggccggccacggccccaagctgggccccgtgaccagaaagcaccccctggtgaccagatacttcaccttccccttcgaggagatcgacttcagcatggaggagagcatgatccacctgcccaacaaggcctgcttcctgatggcccacaacggctgggtgatgggcgacgaccccctgagaaacttcgccgagcccggcagcgaggtgtacctgagaagagagctgatctgctggggcgacagcgtgaagctgagatacggcaacaagcccgaggactgcccctacctgtgggcccacatgaagaagtacaccgagatcaccgccacctacttccagggcgtgagactggacaactgccacagcacccccctgcacgtggccgagtacatgctggacgccgccagaaacctgcagcccaacctgtacgtggtggccgagctgttcaccggcagcgaggacctggacaacgtgttcgtgaccagactgggcatcagcagcctgatcagagaggccatgagcgcctacaacagccacgaggagggcagactggtgtacagatacggcggcgagcccgtgggcagcttcgtgcagccctgcctgagacccctgatgcccgccatcgcccacgccctgttcatggacatcacccacgacaacgagtgccccatcgtgcacagaagcgcctacgacgccctgcccagcaccaccatcgtgagcatggcctgctgcgccagcggcagcaccagaggctacgacgagctggtgccccaccagatcagcgtggtgagcgaggagagattctacaccaagtggaaccccgaggccctgcccagcaacaccggcgaggtgaacttccagagcggcatcatcgccgccagatgcgccatcagcaagctgcaccaggagctgggcgccaagggcttcatccaggtgtacgtggaccaggtggacgaggacatcgtggccgtgaccagacacagccccagcatccaccagagcgtggtggccgtgagcagaaccgccttcagaaaccccaagaccagcttctacagcaaggaggtgccccagatgtgcatccccggcaagatcgaggaggtggtgctggaggccagaaccatcgagagaaacaccaagccctacagaaaggacgagaacagcatcaacggcacccccgacatcaccgtggagatcagagagcacatccagctgaacgagagcaagatcgtgaagcaggccggcgtggccaccaagggccccaacgagtacatccaggagatcgagttcgagaacctgagccccggcagcgtgatcatcttcagagtgagcctggacccccacgcccaggtggccgtgggcatcctgagaaaccacctgacccagttcagcccccacttcaagagcggcagcctggccgtggacaacgccgaccccatcctgaagatccccttcgccagcctggccagcagactgaccctggccgagctgaaccagatcctgtacagatgcgagagcgaggagaaggaggacggcggcggctgctacgacatccccaactggagcgccctgaagtacgccggcctgcagggcctgatgagcgtgctggccgagatcagacccaagaacgacctgggccaccccttctgcaacaacctgagaagcggcgactggatgatcgactacgtgagcaacagactgatcagcagaagcggcaccatcgccgaggtgggcaagtggctgcaggccatgttcttctacctgaagcagatccccagatacctgatcccctgctacttcgacgccatcctgatcggcgcctacaccaccctgctggacaccgcctggaagcagatgagcagcttcgtgcagaacggcagcaccttcgtgaagcacctgagcctgggcagcgtgcagctgtgcggcgtgggcaagttccccagcctgcccatcctgagccccgccctgatggacgtgccctacagactgaacgagatcaccaaggagaaggagcagtgctgcgtgagcctggccgccggcctgccccacttcagcagcggcatcttcagatgctggggcagagacaccttcatcgccctgagaggcatcctgctgatcaccggcagatacgtggaggccagaaacatcatcctggccttcgccggcaccctgagacacggcctgatccccaacctgctgggcgagggcatctacgccagatacaactgcagagacgccgtgtggtggtggctgcagtgcatccaggactactgcaagatggtgcccaacggcctggacatcctgaagtgccccgtgagcagaatgtaccccaccgacgacagcgcccccctgcccgccggcaccctggaccagcccctgttcgaggtgatccaggaggccatgcagaagcacatgcagggcatccagttcagagagagaaacgccggcccccagatcgacagaaacatgaaggacgagggcttcaacatcaccgccggcgtggacgaggagaccggcttcgtgtacggcggcaacagattcaactgcggcacctggatggacaagatgggcgagagcgacagagccagaaacagaggcatccccgccacccccagagacggcagcgccgtggagatcgtgggcctgagcaagagcgccgtgagatggctgctggagctgagcaagaagaacatcttcccctaccacgaggtgaccgtgaagagacacggcaaggccatcaaggtgagctacgacgagtggaacagaaagatccaggacaacttcgagaagctgttccacgtgagcgaggaccccagcgacctgaacgagaagcaccccaacctggtgcacaagagaggcatctacaaggacagctacggcgccagcagcccctggtgcgactaccagctgagacccaacttcaccatcgccatggtggtggcccccgagctgttcaccaccgagaaggcctggaaggccctggagatcgccgagaagaagctgctgggccccctgggcatgaagaccctggaccccgacgacatggtgtactgcggcatctacgacaacgccctggacaacgacaactacaacctggccaagggcttcaactaccaccagggccccgagtggctgtggcccatcggctacttcctgagagccaagctgtacttcagcagactgatgggccccgagaccaccgccaagaccatcgtgctggtgaagaacgtgctgagcagacactacgtgcacctggagagaagcccctggaagggcctgcccgagctgaccaacgagaacgcccagtactgccccttcagctgcgagacccaggcctggagcatcgccaccatcctggagaccctgtacgacctgtag

SEQ ID NO: 1710 - DNA, 4599 bp, Artificial Sequence; identical to SEQ ID NO: 1707
  Description of Artificial Sequence: Synthetic coding sequence

SEQ ID NO: 1711 - DNA, 4551 bp, Artificial Sequence; identical to SEQ ID NO: 1708
  Description of Artificial Sequence: Synthetic coding sequence

SEQ ID NO: 1712 - DNA, 4599 bp, Artificial Sequence; identical to SEQ ID NO: 1707
  Description of Artificial Sequence: Synthetic coding sequence

SEQ ID NO: 1713 - DNA, 4599 bp, Artificial Sequence; identical to SEQ ID NO: 1707
  Description of Artificial Sequence: Synthetic coding sequence

SEQ ID NO: 1714 - DNA, 672 bp, Artificial Sequence
  Description of Artificial Sequence: Synthetic coding sequence
atgaacaagcccctgctgtggatcagcgtgctgaccagcctgctggaggccttcgcccacaccgacctgagcggcaaggtgttcgtgttccccagagagagcgtgaccgaccacgtgaacctgatcacccccctggagaagcccctgcagaacttcaccctgtgcttcagagcctacagcgacctgagcagagcctacagcctgttcagctacaacacccagggcagagacaacgagctgctggtgtacaaggagagagtgggcgagtacagcctgtacatcggcagacacaaggtgaccagcaaggtgatcgagaagttccccgcccccgtgcacatctgcgtgagctgggagagcagcagcggcatcgccgagttctggatcaacggcacccccctggtgaagaagggcctgagacagggctacttcgtggaggcccagcccaagatcgtgctgggccaggagcaggacagctacggcggcaagttcgacagaagccagagcttcgtgggcgagatcggcgacctgtacatgtgggacagcgtgctgccccccgagaacatcctgagcgcctaccagggcacccccctgcccgccaacatcctggactggcaggccctgaactacgagatcagaggctacgtgatcatcaagcccctggtgtgggtgtag

SEQ ID NO: 1715 - DNA, 2418 bp, Artificial Sequence
  Description of Artificial Sequence: Synthetic coding sequence
atgagcagcagcagctggctgctgctgagcctggtggccgtgaccgccgcccagagcaccatcgaggagcaggccaagaccttcctggacaagttcaaccacgaggccgaggacctgttctaccagagcagcctggccagctggaactacaacaccaacatcaccgaggagaacgtgcagaacatgaacaacgccggcgacaagtggagcgccttcctgaaggagcagagcaccctggcccagatgtaccccctgcaggagatccagaacctgaccgtgaagctgcagctgcaggccctgcagcagaacggcagcagcgtgctgagcgaggacaagagcaagagactgaacaccatcctgaacaccatgagcaccatctacagcaccggcaaggtgtgcaaccccgacaacccccaggagtgcctgctgctggagcccggcctgaacgagatcatggccaacagcctggactacaacgagagactgtgggcctgggagagctggagaagcgaggtgggcaagcagctgagacccctgtacgaggagtacgtggtgctgaagaacgagatggccagagccaaccactacgaggactacggcgactactggagaggcgactacgaggtgaacggcgtggacggctacgactacagcagaggccagctgatcgaggacgtggagcacaccttcgaggagatcaagcccctgtacgagcacctgcacgcctacgtgagagccaagctgatgaacgcctaccccagctacatcagccccatcggctgcctgcccgcccacctgctgggcgacatgtggggcagattctggaccaacctgtacagcctgaccgtgcccttcggccagaagcccaacatcgacgtgaccgacgccatggtggaccaggcctgggacgcccagagaatcttcaaggaggccgagaagttcttcgtgagcgtgggcctgcccaacatgacccagggcttctgggagaacagcatgctgaccgaccccggcaacgtgcagaaggccgtgtgccaccccaccgcctgggacctgggcaagggcgacttcagaatcctgatgtgcaccaaggtgaccatggacgacttcctgaccgcccaccacgagatgggccacatccagtacgacatggcctacgccgcccagcccttcctgctgagaaacggcgccaacgagggcttccacgaggccgtgggcgagatcatgagcctgagcgccgccacccccaagcacctgaagagcatcggcctgctgagccccgacttccaggaggacaacgagaccgagatcaacttcctgctgaagcaggccctgaccatcgtgggcaccctgcccttcacctacatgctggagaagtggagatggatggtgttcaagggcgagatccccaaggaccagtggatgaagaagtggtgggagatgaagagagagatcgtgggcgtggtggagcccgtgccccacgacgagacctactgcgaccccgccagcctgttccacgtgagcaacgactacagcttcatcagatactacaccagaaccctgtaccagttccagttccaggaggccctgtgccaggccgccaagcacgagggccccctgcacaagtgcgacatcagcaacagcaccgaggccggccagaagctgttcaacatgctgagactgggcaagagcgagccctggaccctggccctggagaacgtggtgggcgccaagaacatgaacgtgagacccctgctgaactacttcgagcccctgttcacctggctgaaggaccagaacaagaacagcttcgtgggctggagcaccgactggagcccctacgccgaccagagcatcaaggtgagaatcagcctgaagagcgccctgggcgacaaggcctacgagtggaacgacaacgagatgtacctgttcagaagcagcgtggcctacgccatgagacagtacttcctgaaggtgaagaaccagatgatcctgttcggcgaggaggacgtgagagtggccaacctgaagcccagaatcagcttcaacttcttcgtgaccgcccccaagaacgtgagcgacatcatccccagaaccgaggtggagaaggccatcagaatgagcagaagcagaatcaacgacgccttcagactgaacgacaacagcctggagttcctgggcatccagcccaccctgggcccccccaaccagccccccgtgagcatctggctgatcgtgttcggcgtggtgatgggcgtgatcgtggtgggcatcgtgatcctgatcttcaccggcatcagagacagaaagaagaagaacaaggccagaagcggcgagaacccctacgccagcatcgacatcagcaagggcgagaacaaccccggcttccagaacaccgacgacgtgcagaccagcttctag

SEQ ID NO: 1716 - DNA, 2418 bp, Artificial Sequence; identical to SEQ ID NO: 1715
  Description of Artificial Sequence: Synthetic coding sequence

SEQ ID NO: 1717 - DNA, 804 bp, Artificial Sequence
  Description of Artificial Sequence: Synthetic coding sequence
atgaaggccgccgtgctgaccctggccgtgctgttcctgaccggcagccaggccagacacttctggcagcaggacgagcccccccagagcccctgggacagagtgaaggacctggccaccgtgtacgtggacgtgctgaaggacagcggcagagactacgtgagccagttcgagggcagcgccctgggcaagcagctgaacctgaagctgctggacaactgggacagcgtgaccagcaccttcagcaagctgagagagcagctgggccccgtgacccaggagttctgggacaacctggagaaggagaccgagggcctgagacaggagatgagcaaggacctggaggaggtgaaggccaaggtgcagccctacctggacgacttccagaagaagtggcaggaggagatggagctgtacagacagaaggtggagcccctgagagccgagctgcaggagggcgccagacagaagctgcacgagctgcaggagaagctgagccccctgggcgaggagatgagagacagagccagagcccacgtggacgccctgagaacccacctggccccctacagcgacgagctgagacagtgcctggccgccagactggaggccctgaaggagaacggcggcgccagactggccgagtaccacgccaaggccaccgagcacctgagcaccctgagcgagaaggccaagcccgccctggaggacctgagacagggcctgctgcccgtgctggagagcttcaaggtgagcttcctgagcgccctggaggagtacaccaagaagctgaacacccagtag

SEQ ID NO: 1718 - DNA, 804 bp, Artificial Sequence
  Description of Artificial Sequence: Synthetic coding sequence
atgaaggccgccgtgctgaccctggccgtgctgttcctgaccggcagccaggccagacacttctggcagcaggacgagcccccccagagcccctgggacagagtgaaggacctggccaccgtgtacgtggacgtgctgaaggacagcggcagagactacgtgagccagttcgagggcagcgccctgggcaagcagctgaacctgaagctgctggacaactgggacagcgtgaccagcaccttcagcaagctgagagagcagctgggccccgtgacccaggagttctgggacaacctggagaaggagaccgagggcctgagacaggagatgagcaaggacctggaggaggtgaaggccaaggtgcagccctacctggacgacttccagaagaagtggcaggaggagatggagctgtacagacagaaggtggagcccctgagagccgagctgcaggagggcgccagacagaagctgcacgagctgcaggagaagctgagccccctgggcgaggagatgagagactgcgccagagcccacgtggacgccctgagaacccacctggccccctacagcgacgagctgagacagagactggccgccagactggaggccctgaaggagaacggcggcgccagactggccgagtaccacgccaaggccaccgagcacctgagcaccctgagcgagaaggccaagcccgccctggaggacctgagacagggcctgctgcccgtgctggagagcttcaaggtgagcttcctgagcgccctggaggagtacaccaagaagctgaacacccagtag

SEQ ID NO: 1719 - DNA, 804 bp, Artificial Sequence
  Description of Artificial Sequence: Synthetic coding sequence
atgaaggccgccgtgctgaccctggccgtgctgttcctgaccggcagccaggccagacacttctggcagcaggacgagcccccccagagcccctgggacagagtgaaggacctggccaccgtgtacgtggacgtgctgaaggacagcggcagagactacgtgagccagttcgagggcagcgccctgggcaagcagctgaacctgaagctgctggacaactgggacagcgtgaccagcaccttcagcaagctgagagagcagctgggccccgtgacccaggagttctgggacaacctggagaaggagaccgagggcctgagacaggagatgagcaaggacctggaggaggtgaaggccaaggtgcagccctacctggacgacttccagaagaagtggcaggaggagatggagctgtacagacagaaggtggagcccctgagagccgagctgcaggagggcgccagacagaagctgcacgagctgcaggagaagctgagccccctgggcgaggagatgagagacagagccagagcccacgtggacgccctgagaacccacctggccccctacagcgacgagctgagacagagactggccgccagactggaggccctgaaggagaacggcggcgccagactggccgagtaccacgccaaggccaccgagcacctgagcaccctgagcgagaaggccaagcccgccctggaggacctgagacagggcctgctgcccgtgctggagagcttcaaggtgagcttcctgagcgccctggaggagtacaccaagaagctgaacacccagtag

SEQ ID NO: 1720 - DNA, 804 bp, Artificial Sequence; identical to SEQ ID NO: 1719
  Description of Artificial Sequence: Synthetic coding sequence

SEQ ID NO: 1721 - DNA, 804 bp, Artificial Sequence; identical to SEQ ID NO: 1719
  Description of Artificial Sequence: Synthetic coding sequence

SEQ ID NO: 1722 - DNA, 804 bp, Artificial Sequence; identical to SEQ ID NO: 1719
  Description of Artificial Sequence: Synthetic coding sequence

SEQ ID NO: 1723 - DNA, 1653 bp, Artificial Sequence
  Description of Artificial Sequence: Synthetic coding sequence
atgaccggcgacaagggcccccagagactgagcggcagcagctacggcagcatcagcagccccaccagccccaccagccccggcccccagcaggccccccccagagagacctacctgagcgagaagatccccatccccgacaccaagcccggcaccttcagcctgagaaagctgtgggccttcaccggccccggcttcctgatgagcatcgccttcctggaccccggcaacatcgagagcgacctgcaggccggcgccgtggccggcttcaagctgctgtgggtgctgctgtgggccaccgtgctgggcctgctgtgccagagactggccgccagactgggcgtggtgaccggcaaggacctgggcgaggtgtgccacctgtactaccccaaggtgcccagaaccgtgctgtggctgaccatcgagctggccatcgtgggcagcgacatgcaggaggtgatcggcaccgccatcgccttcaacctgctgagcgccggcagaatccccctgtggggcggcgtgctgatcaccatcgtggacaccttcttcttcctgttcctggacaactacggcctgagaaagctggaggccttcttcggcctgctgatcaccatcatggccctgaccttcggctacgagtacgtggtggccagacccgagcagggcgccctgctgagaggcctgttcctgcccagctgccccggctgcggccaccccgagctgctgcaggccgtgggcatcgtgggcgccatcatcatgccccacaacatctacctgcacagcgccctggtgaagagcagagagatcgacagagccagaagagccgacatcagagaggccaacatgtacttcctgatcgaggccaccatcgccctgagcgtgagcttcatcatcaacctgttcgtgatggccgtgttcggccaggccttctaccagaagaccaaccaggccgccttcaacatctgcgccaacagcagcctgcacgactacgccaagatcttccccatgaacaacgccaccgtggccgtggacatctaccagggcggcgtgatcctgggctgcctgttcggccccgccgccctgtacatctgggccatcggcctgctggccgccggccagagcagcaccatgaccggcacctacgccggccagttcgtgatggagggcttcctgagactgagatggagcagattcgccagagtgctgctgaccagaagctgcgccatcctgcccaccgtgctggtggccgtgttcagagacctgagagacctgagcggcctgaacgacctgctgaacgtgctgcagagcctgctgctgcccttcgccgtgctgcccatcctgaccttcaccagcatgcccaccctgatgcaggagttcgccaacggcctgctgaacaaggtggtgaccagcagcatcatggtgctggtgtgcgccatcaacctgtacttcgtggtgagctacctgcccagcctgccccaccccgcctacttcggcctggccgccctgctggccgccgcctacctgggcctgagcacctacctggtgtggacctgctgcctggcccacggcgccaccttcctggcccacagcagccaccaccacttcctgtacggcctgctggaggaggaccagaagggcgagaccagcggctag

SEQ ID NO: 1724 - DNA, 13035 bp, Artificial Sequence
  Description of Artificial Sequence: Synthetic coding sequence
atggacccccccagacccgccctgctggccctgctggccctgcccgccctgctgctgctgctgctggccggcgccagagccgaggaggagatgctggagaacgtgagcctggtgtgccccaaggacgccaccagattcaagcacctgagaaagtacacctacaactacgaggccgagagcagcagcggcgtgcccggcaccgccgacagcagaagcgccaccagaatcaactgcaaggtggagctggaggtgccccagctgtgcagcttcatcctgaagaccagccagtgcaccctgaaggaggtgtacggcttcaaccccgagggcaaggccctgctgaagaagaccaagaacagcgaggagttcgccgccgccatgagcagatacgagctgaagctggccatccccgagggcaagcaggtgttcctgtaccccgagaaggacgagcccacctacatcctgaacatcaagagaggcatcatcagcgccctgctggtgccccccgagaccgaggaggccaagcaggtgctgttcctggacaccgtgtacggcaactgcagcacccacttcaccgtgaagaccagaaagggcaacgtggccaccgagatcagcaccgagagagacctgggccagtgcgacagattcaagcccatcagaaccggcatcagccccctggccctgatcaagggcatgaccagacccctgagcaccctgatcagcagcagccagagctgccagtacaccctggacgccaagagaaagcacgtggccgaggccatctgcaaggagcagcacctgttcctgcccttcagctacaagaacaagtacggcatggtggcccaggtgacccagaccctgaagctggaggacacccccaagatcaacagcagattcttcggcgagggcaccaagaagatgggcctggccttcgagagcaccaagagcaccagcccccccaagcaggccgaggccgtgctgaagaccctgcaggagctgaagaagctgaccatcagcgagcagaacatccagagagccaacctgttcaacaagctggtgaccgagctgagaggcctgagcgacgaggccgtgaccagcctgctgccccagctgatcgaggtgagcagccccatcaccctgcaggccctggtgcagtgcggccagccccagtgcagcacccacatcctgcagtggctgaagagagtgcacgccaaccccctgctgatcgacgtggtgacctacctggtggccctgatccccgagcccagcgcccagcagctgagagagatcttcaacatggccagagaccagagaagcagagccaccctgtacgccctgagccacgccgtgaacaactaccacaagaccaaccccaccggcacccaggagctgctggacatcgccaactacctgatggagcagatccaggacgactgcaccggcgacgaggactacacctacctgatcctgagagtgatcggcaacatgggccagaccatggagcagctgacccccgagctgaagagcagcatcctgaagtgcgtgcagagcaccaagcccagcctgatgatccagaaggccgccatccaggccctgagaaagatggagcccaaggacaaggaccaggaggtgctgctgcagaccttcctggacgacgccagccccggcgacaagagactggccgcctacctgatgctgatgagaagccccagccaggccgacatcaacaagatcgtgcagatcctgccctgggagcagaacgagcaggtgaagaacttcgtggccagccacatcgccaacatcctgaacagcgaggagctggacatccaggacctgaagaagctggtgaaggaggccctgaaggagagccagctgcccaccgtgatggacttcagaaagttcagcagaaactaccagctgtacaagagcgtgagcctgcccagcctggaccccgccagcgccaagatcgagggcaacctgatcttcgaccccaacaactacctgcccaaggagagcatgctgaagaccaccctgaccgccttcggcttcgccagcgccgacctgatcgagatcggcctggagggcaagggcttcgagcccaccctggaggccctgttcggcaagcagggcttcttccccgacagcgtgaacaaggccctgtactgggtgaacggccaggtgcccgacggcgtgagcaaggtgctggtggaccacttcggctacaccaaggacgacaagcacgagcaggacatggtgaacggcatcatgctgagcgtggagaagctgatcaaggacctgaagagcaaggaggtgcccgaggccagagcctacctgagaatcctgggcgaggagctgggcttcgccagcctgcacgacctgcagctgctgggcaagctgctgctgatgggcgccagaaccctgcagggcatcccccagatgatcggcgaggtgatcagaaagggcagcaagaacgacttcttcctgcactacatcttcatggagaacgccttcgagctgcccaccggcgccggcctgcagctgcagatcagcagcagcggcgtgatcgcccccggcgccaaggccggcgtgaagctggaggtggccaacatgcaggccgagctggtggccaagcccagcgtgagcgtggagttcgtgaccaacatgggcatcatcatccccgacttcgccagaagcggcgtgcagatgaacaccaacttcttccacgagagcggcctggaggcccacgtggccctgaaggccggcaagctgaagttcatcatccccagccccaagagacccgtgaagctgctgagcggcggcaacaccctgcacctggtgagcaccaccaagaccgaggtgatcccccccctgatcgagaacagacagagctggagcgtgtgcaagcaggtgttccccggcctgaactactgcaccagcggcgcctacagcaacgccagcagcaccgacagcgccagctactaccccctgaccggcgacaccagactggagctggagctgagacccaccggcgagatcgagcagtacagcgtgagcgccacctacgagctgcagagagaggacagagccctggtggacaccctgaagttcgtgacccaggccgagggcgccaagcagaccgaggccaccatgaccttcaagtacaacagacagagcatgaccctgagcagcgaggtgcagatccccgacttcgacgtggacctgggcaccatcctgagagtgaacgacgagagcaccgagggcaagaccagctacagactgaccctggacatccagaacaagaagatcaccgaggtggccctgatgggccacctgagctgcgacaccaaggaggagagaaagatcaagggcgtgatcagcatccccagactgcaggccgaggccagaagcgagatcctggcccactggagccccgccaagctgctgctgcagatggacagcagcgccaccgcctacggcagcaccgtgagcaagagagtggcctggcactacgacgaggagaagatcgagttcgagtggaacaccggcaccaacgtggacaccaagaagatgaccagcaacttccccgtggacctgagcgactaccccaagagcctgcacatgtacgccaacagactgctggaccacagagtgccccagaccgacatgaccttcagacacgtgggcagcaagctgatcgtggccatgagcagctggctgcagaaggccagcggcagcctgccctacacccagaccctgcaggaccacctgaacagcctgaaggagttcaacctgcagaacatgggcctgcccgacttccacatccccgagaacctgttcctgaagagcgacggcagagtgaagtacaccctgaacaagaacagcctgaagatcgagatccccctgcccttcggcggcaagagcagcagagacctgaagatgctggagaccgtgagaacccccgccctgcacttcaagagcgtgggcttccacctgcccagcagagagttccaggtgcccaccttcaccatccccaagctgtaccagctgcaggtgcccctgctgggcgtgctggacctgagcaccaacgtgtacagcaacctgtacaactggagcgccagctacagcggcggcaacaccagcaccgaccacttcagcctgagagccagataccacatgaaggccgacagcgtggtggacctgctgagctacaacgtgcagggcagcggcgagaccacctacgaccacaagaacaccttcaccctgagctacgacggcagcctgagacacaagttcctggacagcaacatcaagttcagccacgtggagaagctgggcaacaaccccgtgagcaagggcctgctgatcttcgacgccagcagcagctggggcccccagatgagcgccagcgtgcacctggacagcaagaagaagcagcacctgttcgtgaaggaggtgaagatcgacggccagttcagagtgagcagcttctacgccaagggcacctacggcctgagctgccagagagaccccaacaccggcagactgaacggcgagagcaacctgagattcaacagcagctacctgcagggcaccaaccagatcaccggcagatacgaggacggcaccctgagcctgaccagcaccagcgacctgcagagcggcatcatcaagaacaccgccagcctgaagtacgagaactacgagctgaccctgaagagcgacaccaacggcaagtacaagaacttcgccaccagcaacaagatggacatgaccttcagcaagcagaacgccctgctgagaagcgagtaccaggccgactacgagagcctgagattcttcagcctgctgagcggcagcctgaacagccacggcctggagctgaacgccgacatcctgggcaccgacaagatcaacagcggcgcccacaaggccaccctgagaatcggccaggacggcatcagcaccagcgccaccaccaacctgaagtgcagcctgctggtgctggagaacgagctgaacgccgagctgggcctgagcggcgccagcatgaagctgaccaccaacggcagattcagagagcacaacgccaagttcagcctggacggcaaggccgccctgaccgagctgagcctgggcagcgcctaccaggccatgatcctgggcgtggacagcaagaacatcttcaacttcaaggtgagccaggagggcctgaagctgagcaacgacatgatgggcagctacgccgagatgaagttcgaccacaccaacagcctgaacatcgccggcctgagcctggacttcagcagcaagctggacaacatctacagcagcgacaagttctacaagcagaccgtgaacctgcagctgcagccctacagcctggtgaccaccctgaacagcgacctgaagtacaacgccctggacctgaccaacaacggcaagctgagactggagcccctgaagctgcacgtggccggcaacctgaagggcgcctaccagaacaacgagatcaagcacatctacgccatcagcagcgccgccctgagcgccagctacaaggccgacaccgtggccaaggtgcagggcgtggagttcagccacagactgaacaccgacatcgccggcctggccagcgccatcgacatgagcaccaactacaacagcgacagcctgcacttcagcaacgtgttcagaagcgtgatggcccccttcaccatgaccatcgacgcccacaccaacggcaacggcaagctggccctgtggggcgagcacaccggccagctgtacagcaagttcctgctgaaggccgagcccctggccttcaccttcagccacgactacaagggcagcaccagccaccacctggtgagcagaaagagcatcagcgccgccctggagcacaaggtgagcgccctgctgacccccgccgagcagaccggcacctggaagctgaagacccagttcaacaacaacgagtacagccaggacctggacgcctacaacaccaaggacaagatcggcgtggagctgaccggcagaaccctggccgacctgaccctgctggacagccccatcaaggtgcccctgctgctgagcgagcccatcaacatcatcgacgccctggagatgagagacgccgtggagaagccccaggagttcaccatcgtggccttcgtgaagtacgacaagaaccaggacgtgcacagcatcaacctgcccttcttcgagaccctgcaggagtacttcgagagaaacagacagaccatcatcgtggtgctggagaacgtgcagagaaacctgaagcacatcaacatcgaccagttcgtgagaaagtacagagccgccctgggcaagctgccccagcaggccaacgactacctgaacagcttcaactgggagagacaggtgagccacgccaaggagaagctgaccgccctgaccaagaagtacagaatcaccgagaacgacatccagatcgccctggacgacgccaagatcaacttcaacgagaagctgagccagctgcagacctacatgatccagttcgaccagtacatcaaggacagctacgacctgcacgacctgaagatcgccatcgccaacatcatcgacgagatcatcgagaagctgaagagcctggacgagcactaccacatcagagtgaacctggtgaagaccatccacgacctgcacctgttcatcgagaacatcgacttcaacaagagcggcagcagcaccgccagctggatccagaacgtggacaccaagtaccagatcagaatccagatccaggagaagctgcagcagctgaagagacacatccagaacatcgacatccagcacctggccggcaagctgaagcagcacatcgaggccatcgacgtgagagtgctgctggaccagctgggcaccaccatcagcttcgagagaatcaacgacatcctggagcacgtgaagcacttcgtgatcaacctgatcggcgacttcgaggtggccgagaagatcaacgccttcagagccaaggtgcacgagctgatcgagagatacgaggtggaccagcagatccaggtgctgatggacaagctggtggagctggcccaccagtacaagctgaaggagaccatccagaagctgagcaacgtgctgcagcaggtgaagatcaaggactacttcgagaagctggtgggcttcatcgacgacgccgtgaagaagctgaacgagctgagcttcaagaccttcatcgaggacgtgaacaagttcctggacatgctgatcaagaagctgaagagcttcgactaccaccagttcgtggacgagaccaacgacaagatcagagaggtgacccagagactgaacggcgagatccaggccctggagctgccccagaaggccgaggccctgaagctgttcctggaggagaccaaggccaccgtggccgtgtacctggagagcctgcaggacaccaagatcaccctgatcatcaactggctgcaggaggccctgagcagcgccagcctggcccacatgaaggccaagttcagagagaccctggaggacaccagagacagaatgtaccagatggacatccagcaggagctgcagagatacctgagcctggtgggccaggtgtacagcaccctggtgacctacatcagcgactggtggaccctggccgccaagaacctgaccgacttcgccgagcagtacagcatccaggactgggccaagagaatgaaggccctggtggagcagggcttcaccgtgcccgagatcaagaccatcctgggcaccatgcccgccttcgaggtgagcctgcaggccctgcagaaggccaccttccagacccccgacttcatcgtgcccctgaccgacctgagaatccccagcgtgcagatcaacttcaaggacctgaagaacatcaagatccccagcagattcagcacccccgagttcaccatcctgaacaccttccacatccccagcttcaccatcgacttcgtggagatgaaggtgaagatcatcagaaccatcgaccagatgctgaacagcgagctgcagtggcccgtgcccgacatctacctgagagacctgaaggtggaggacatccccctggccagaatcaccctgcccgacttcagactgcccgagatcgccatccccgagttcatcatccccaccctgaacctgaacgacttccaggtgcccgacctgcacatccccgagttccagctgccccacatcagccacaccatcgaggtgcccaccttcggcaagctgtacagcatcctgaagatccagagccccctgttcaccctggacgccaacgccgacatcggcaacggcaccaccagcgccaacgaggccggcatcgccgccagcatcaccgccaagggcgagagcaagctggaggtgctgaacttcgacttccaggccaacgcccagctgagcaaccccaagatcaaccccctggccctgaaggagagcgtgaagttcagcagcaagtacctgagaaccgagcacggcagcgagatgctgttcttcggcaacgccatcgagggcaagagcaacaccgtggccagcctgcacaccgagaagaacaccctggagctgagcaacggcgtgatcgtgaagatcaacaaccagctgaccctggacagcaacaccaagtacttccacaagctgaacatccccaagctggacttcagcagccaggccgacctgagaaacgagatcaagaccctgctgaaggccggccacatcgcctggaccagcagcggcaagggcagctggaagtgggcctgccccagattcagcgacgagggcacccacgagagccagatcagcttcaccatcgagggccccctgaccagcttcggcctgagcaacaagatcaacagcaagcacctgagagtgaaccagaacctggtgtacgagagcggcagcctgaacttcagcaagctggagatccagagccaggtggacagccagcacgtgggccacagcgtgctgaccgccaagggcatggccctgttcggcgagggcaaggccgagttcaccggcagacacgacgcccacctgaacggcaaggtgatcggcaccctgaagaacagcctgttcttcagcgcccagcccttcgagatcaccgccagcaccaacaacgagggcaacctgaaggtgagattccccctgagactgaccggcaagatcgacttcctgaacaactacgccctgttcctgagccccagcgcccagcaggccagctggcaggtgagcgccagattcaaccagtacaagtacaaccagaacttcagcgccggcaacaacgagaacatcatggaggcccacgtgggcatcaacggcgaggccaacctggacttcctgaacatccccctgaccatccccgagatgagactgccctacaccatcatcaccaccccccccctgaaggacttcagcctgtgggagaagaccggcctgaaggagttcctgaagaccaccaagcagagcttcgacctgagcgtgaaggcccagtacaagaagaacaagcacagacacagcatcaccaaccccctggccgtgctgtgcgagttcatcagccagagcatcaagagcttcgacagacacttcgagaagaacagaaacaacgccctggacttcgtgaccaagagctacaacgagaccaagatcaagttcgacaagtacaaggccgagaagagccacgacgagctgcccagaaccttccagatccccggctacaccgtgcccgtggtgaacgtggaggtgagccccttcaccatcgagatgagcgccttcggctacgtgttccccaaggccgtgagcatgcccagcttcagcatcctgggcagcgacgtgagagtgcccagctacaccctgatcctgcccagcctggagctgcccgtgctgcacgtgcccagaaacctgaagctgagcctgcccgacttcaaggagctgtgcaccatcagccacatcttcatccccgccatgggcaacatcacctacgacttcagcttcaagagcagcgtgatcaccctgaacaccaacgccgagctgttcaaccagagcgacatcgtggcccacctgctgagcagcagcagcagcgtgatcgacgccctgcagtacaagctggagggcaccaccagactgaccagaaagagaggcctgaagctggccaccgccctgagcctgagcaacaagttcgtggagggcagccacaacagcaccgtgagcctgaccaccaagaacatggaggtgagcgtggccaccaccaccaaggcccagatccccatcctgagaatgaacttcaagcaggagctgaacggcaacaccaagagcaagcccaccgtgagcagcagcatggagttcaagtacgacttcaacagcagcatgctgtacagcaccgccaagggcgccgtggaccacaagctgagcctggagagcctgaccagctacttcagcatcgagagcagcaccaagggcgacgtgaagggcagcgtgctgagcagagagtacagcggcaccatcgccagcgaggccaacacctacctgaacagcaagagcaccagaagcagcgtgaagctgcagggcaccagcaagatcgacgacatctggaacctggaggtgaaggagaacttcgccggcgaggccaccctgcagagaatctacagcctgtgggagcacagcaccaagaaccacctgcagctggagggcctgttcttcaccaacggcgagcacaccagcaaggccaccctggagctgagcccctggcagatgagcgccctggtgcaggtgcacgccagccagcccagcagcttccacgacttccccgacctgggccaggaggtggccctgaacgccaacaccaagaaccagaagatcagatggaagaacgaggtgagaatccacagcggcagcttccagagccaggtggagctgagcaacgaccaggagaaggcccacctggacatcgccggcagcctggagggccacctgagattcctgaagaacatcatcctgcccgtgtacgacaagagcctgtgggacttcctgaagctggacgtgaccaccagcatcggcagaagacagcacctgagagtgagcaccgccttcgtgtacaccaagaaccccaacggctacagcttcagcatccccgtgaaggtgctggccgacaagttcatcatccccggcctgaagctgaacgacctgaacagcgtgctggtgatgcccaccttccacgtgcccttcaccgacctgcaggtgcccagctgcaagctggacttcagagagatccagatctacaagaagctgagaaccagcagcttcgccctgaacctgcccaccctgcccgaggtgaagttccccgaggtggacgtgctgaccaagtacagccagcccgaggacagcctgatccccttcttcgagatcaccgtgcccgagagccagctgaccgtgagccagttcaccctgcccaagagcgtgagcgacggcatcgccgccctggacctgaacgccgtggccaacaagatcgccgacttcgagctgcccaccatcatcgtgcccgagcagaccatcgagatccccagcatcaagttcagcgtgcccgccggcatcgtgatccccagcttccaggccctgaccgccagattcgaggtggacagccccgtgtacaacgccacctggagcgccagcctgaagaacaaggccgactacgtggagaccgtgctggacagcacctgcagcagcaccgtgcagttcctggagtacgagctgaacgtgctgggcacccacaagatcgaggacggcaccctggccagcaagaccaagggcaccttcgcccacagagacttcagcgccgagtacgaggaggacggcaagtacgagggcctgcaggagtgggagggcaaggcccacctgaacatcaagagccccgccttcaccgacctgcacctgagataccagaaggacaagaagggcatcagcaccagcgccgccagccccgccgtgggcaccgtgggcatggacatggacgaggacgacgacttcagcaagtggaacttctactacagcccccagagcagccccgacaagaagctgaccatcttcaagaccgagctgagagtgagagagagcgacgaggagacccagatcaaggtgaactgggaggaggaggccgccagcggcctgctgaccagcctgaaggacaacgtgcccaaggccaccggcgtgctgtacgactacgtgaacaagtaccactgggagcacaccggcctgaccctgagagaggtgagcagcaagctgagaagaaacctgcagaacaacgccgagtgggtgtaccagggcgccatcagacagatcgacgacatcgacgtgagattccagaaggccgccagcggcaccaccggcacctaccaggagtggaaggacaaggcccagaacctgtaccaggagctgctgacccaggagggccaggccagcttccagggcctgaaggacaacgtgttcgacggcctggtgagagtgacccaggagttccacatgaaggtgaagcacctgatcgacagcctgatcgacttcctgaacttccccagattccagttccccggcaagcccggcatctacaccagagaggagctgtgcaccatgttcatcagagaggtgggcaccgtgctgagccaggtgtacagcaaggtgcacaacggcagcgagatcctgttcagctacttccaggacctggtgatcaccctgcccttcgagctgagaaagcacaagctgatcgacgtgatcagcatgtacagagagctgctgaaggacctgagcaaggaggcccaggaggtgttcaaggccatccagagcctgaagaccaccgaggtgctgagaaacctgcaggacctgctgcagttcatcttccagctgatcgaggacaacatcaagcagctgaaggagatgaagttcacctacctgatcaactacatccaggacgagatcaacaccatcttcagcgactacatcccctgcttctag

SEQ ID NO: 1725 - DNA, 798 bp, Artificial Sequence
  Description of Artificial Sequence: Synthetic coding sequence
atgaagaaggaggtgtgcagcgtggccttcctgaaggccgtgttcgccgagttcctggccaccctgatcttcgtgttcttcggcctgggcagcgccctgaagtggcccagcgccctgcccaccatcctgcagatcgccctggccttcggcctggccatcggcaccctggcccaggccctgggccccgtgagcggcggccacatcaaccccgccatcaccctggccctgctggtgggcaaccagatcagcctgctgagagccttcttctacgtggccgcccagctggtgggcgccatcgccggcgccggcatcctgtacggcgtggcccccctgaacgccagaggcaacctggccgtgaacgccctgaacaacaacaccacccagggccaggccatggtggtggagctgatcctgaccttccagctggccctgtgcatcttcgccagcaccgacagcagaagaaccagccccgtgggcagccccgccctgagcatcggcctgagcgtgaccctgggccacctggtgggcatctacttcaccggctgcagcatgaaccccgccagaagcttcggccccgccgtggtgatgaacagattcagccccgcccactgggtgttctgggtgggccccatcgtgggcgccgtgctggccgccatcctgtacttctacctgctgttccccaacagcctgagcctgagcgagagagtggccatcatcaagggcacctacgagcccgacgaggactgggaggagcagagagaggagagaaagaagaccatggagctgaccaccagatag

SEQ ID NO: 1726 - DNA, 993 bp, Artificial Sequence
  Description of Artificial Sequence: Synthetic coding sequence
atgagcgccaagagcagaaccatcggcatcatcggcgcccccttcagcaagggccagcccagaggcggcgtggaggagggccccaccgtgctgagaaaggccggcctgctggagaagctgaaggagcaggtgacccagaacttcctgatcctggagtgcgacgtgaaggactacggcgacctgcccttcgccgacatccccaacgacagccccttccagatcgtgaagaaccccagaagcgtgggcaaggccagcgagcagctggccggcaaggtggccgaggtgaagaagaacggcagaatcagcctggtgctgggcggcgaccacagcctggccatcggcagcatcagcggccacgccagagtgcaccccgacctgggcgtgatctgggtggacgcccacaccgacatcaacacccccctgaccaccaccagcggcaacctgcacggccagcccgtgagcttcctgctgaaggagctgaagggcaagatccccgacgtgcccggcttcagctgggtgaccccctgcatcagcgccaaggacatcgtgtacatcggcctgagagacgtggaccccggcgagcactacatcctgaagaccctgggcatcaagtacttcagcatgaccgaggtggacagactgggcatcggcaaggtgatggaggagaccctgagctacctgctgggcagaaagaagagacccatccacctgagcttcgacgtggacggcctggaccccagcttcacccccgccaccggcacccccgtggtgggcggcctgacctacagagagggcctgtacatcaccgaggagatctacaagaccggcctgctgagcggcctggacatcatggaggtgaaccccagcctgggcaagacccccgaggaggtgaccagaaccgtgaacaccgccgtggccatcaccctggcctgcttcggcctggccagagagggcaaccacaagcccatcgactacctgaacccccccaagtag

SEQ ID NO: 1727 - DNA, 969 bp, Artificial Sequence
  Description of Artificial Sequence: Synthetic coding sequence
atgagcgccaagagcagaaccatcggcatcatcggcgcccccttcagcaagggccagcccagaggcggcgtggaggagggccccaccgtgctgagaaaggccggcctgctggagaagctgaaggagcaggagtgcgacgtgaaggactacggcgacctgcccttcgccgacatccccaacgacagccccttccagatcgtgaagaaccccagaagcgtgggcaaggccagcgagcagctggccggcaaggtggccgaggtgaagaagaacggcagaatcagcctggtgctgggcggcgaccacagcctggccatcggcagcatcagcggccacgccagagtgcaccccgacctgggcgtgatctgggtggacgcccacaccgacatcaacacccccctgaccaccaccagcggcaacctgcacggccagcccgtgagcttcctgctgaaggagctgaagggcaagatccccgacgtgcccggcttcagctgggtgaccccctgcatcagcgccaaggacatcgtgtacatcggcctgagagacgtggaccccggcgagcactacatcctgaagaccctgggcatcaagtacttcagcatgaccgaggtggacagactgggcatcggcaaggtgatggaggagaccctgagctacctgctgggcagaaagaagagacccatccacctgagcttcgacgtggacggcctggaccccagcttcacccccgccaccggcacccccgtggtgggcggcctgacctacagagagggcctgtacatcaccgaggagatctacaagaccggcctgctgagcggcctggacatcatggaggtgaaccccagcctgggcaagacccccgaggaggtgaccagaaccgtgaacaccgccgtggccatcaccctggcctgcttcggcctggccagagagggcaaccacaagcccatcgactacctgaacccccccaagtag

SEQ ID NO: 1728 - DNA, 711 bp, Artificial Sequence
  Description of Artificial Sequence: Synthetic coding sequence
atgagcgccaagagcagaaccatcggcatcatcggcgcccccttcagcaagggccagcccagaggcggcgtggaggagggccccaccgtgctgagaaaggccggcctgctggagaagctgaaggagcaggagtgcgacgtgaaggactacggcgacctgcccttcgccgacatccccaacgacagccccttccagatcgtgaagaaccccagaagcgtgggcaaggccagcgagcagctggccggcaaggtggccgaggtgaagaagaacggcagaatcagcctggtgctgggcggcgaccacagcctggccatcggcagcatcagcggccacgccagagtgcaccccgacctgggcgtgatctgggtggacgcccacaccgacatcaacacccccctgaccaccaccagcggcaacctgcacggccagcccgtgagcttcctgctgaaggagctgaagggcaagatccccgacgtgcccggcttcagctgggtgaccccctgcatcagcgccaaggacatcgtgtacatcggcctgagagacgtggaccccggcgagcactacatcctgaagaccctgggcatcaagtacttcagcatgaccgaggtgaccagaaccgtgaacaccgccgtggccatcaccctggcctgcttcggcctggccagagagggcaaccacaagcccatcgactacctgaacccccccaagtag

SEQ ID NO: 1729 - DNA, 1395 bp, Artificial Sequence
  Description of Artificial Sequence: Synthetic coding sequence
atggccagcgagagcggcaagctgtggggcggcagattcgtgggcgccgtggaccccatcatggagaagttcaacgccagcatcgcctacgacagacacctgtgggaggtggacgtgcagggcagcaaggcctacagcagaggcctggagaaggccggcctgctgaccaaggccgagatggaccagatcctgcacggcctggacaaggtggccgaggagtgggcccagggcaccttcaagctgaacagcaacgacgaggacatccacaccgccaacgagagaagactgaaggagctgatcggcgccaccgccggcaagctgcacaccggcagaagcagaaacgaccaggtggtgaccgacctgagactgtggatgagacagacctgcagcaccctgagcggcctgctgtgggagctgatcagaaccatggtggacagagccgaggccgagagagacgtgctgttccccggctacacccacctgcagagagcccagcccatcagatggagccactggatcctgagccacgccgtggccctgaccagagacagcgagagactgctggaggtgagaaagagaatcaacgtgctgcccctgggcagcggcgccatcgccggcaaccccctgggcgtggacagagagctgctgagagccgagctgaacttcggcgccatcaccctgaacagcatggacgccaccagcgagagagacttcgtggccgagttcctgttctgggccagcctgtgcatgacccacctgagcagaatggccgaggacctgatcctgtactgcaccaaggagttcagcttcgtgcagctgagcgacgcctacagcaccggcagcagcctgatgccccagaagaagaaccccgacagcctggagctgatcagaagcaaggccggcagagtgttcggcagatgcgccggcctgctgatgaccctgaagggcctgcccagcacctacaacaaggacctgcaggaggacaaggaggccgtgttcgaggtgagcgacaccatgagcgccgtgctgcaggtggccaccggcgtgatcagcaccctgcagatccaccaggagaacatgggccaggccctgagccccgacatgctggccaccgacctggcctactacctggtgagaaagggcatgcccttcagacaggcccacgaggccagcggcaaggccgtgttcatggccgagaccaagggcgtggccctgaaccagctgagcctgcaggagctgcagaccatcagccccctgttcagcggcgacgtgatctgcgtgtgggactacggccacagcgtggagcagtacggcgccctgggcggcaccgccagaagcagcgtggactggcagatcagacaggtgagagccctgctgcaggcccagcaggcctag

SEQ ID NO: 1730 - DNA, 1317 bp, Artificial Sequence
  Description of Artificial Sequence: Synthetic coding sequence
atggccagcgagagcggcaagctgtggggcggcagattcgtgggcgccgtggaccccatcatggagaagttcaacgccagcatcgcctacgacagacacctgtgggaggtggacgtgcagggcagcaaggcctacagcagaggcctggagaaggccggcctgctgaccaaggccgagatggaccagatcctgcacggcctggacaaggtggccgaggagtgggcccagggcaccttcaagctgaacagcaacgacgaggacatccacaccgccaacgagagaagactgaaggagctgatcggcgccaccgccggcaagctgcacaccggcagaagcagaaacgaccaggtggtgaccgacctgagactgtggatgagacagacctgcagcaccctgagcggcctgctgtgggagctgatcagaaccatggtggacagagccgaggccgagagagacgtgctgttccccggctacacccacctgcagagagcccagcccatcagatggagccactggatcctgagcggcgccatcgccggcaaccccctgggcgtggacagagagctgctgagagccgagctgaacttcggcgccatcaccctgaacagcatggacgccaccagcgagagagacttcgtggccgagttcctgttctgggccagcctgtgcatgacccacctgagcagaatggccgaggacctgatcctgtactgcaccaaggagttcagcttcgtgcagctgagcgacgcctacagcaccggcagcagcctgatgccccagaagaagaaccccgacagcctggagctgatcagaagcaaggccggcagagtgttcggcagatgcgccggcctgctgatgaccctgaagggcctgcccagcacctacaacaaggacctgcaggaggacaaggaggccgtgttcgaggtgagcgacaccatgagcgccgtgctgcaggtggccaccggcgtgatcagcaccctgcagatccaccaggagaacatgggccaggccctgagccccgacatgctggccaccgacctggcctactacctggtgagaaagggcatgcccttcagacaggcccacgaggccagcggcaaggccgtgttcatggccgagaccaagggcgtggccctgaaccagctgagcctgcaggagctgcagaccatcagccccctgttcagcggcgacgtgatctgcgtgtgggactacggccacagcgtggagcagtacggcgccctgggcggcaccgccagaagcagcgtggactggcagatcagacaggtgagagccctgctgcaggcccagcaggcctag

SEQ ID NO: 1731 - DNA, 1335 bp, Artificial Sequence
  Description of Artificial Sequence: Synthetic coding sequence
atggccagcgagagcggcaagctgtggggcggcagattcgtgggcgccgtggaccccatcatggagaagttcaacgccagcatcgcctacgacagacacctgtgggaggtggacgtgcagggcagcaaggcctacagcagaggcctggagaaggccggcctgctgaccaaggccgagatggaccagatcctgcacggcctggacaaggtggccgaggagtgggcccagggcaccttcaagctgaacagcaacgacgaggacatccacaccgccaacgagagaagactgaaggagctgatcggcgccaccgccggcaagctgcacaccggcagaagcagaaacgaccaggtggtgaccgacctgagactgtggatgagacagacctgcagcaccctgagcggcctgctgtgggagctgatcagaaccatggtggacagagccgaggccgagagagacgtgctgttccccggctacacccacctgcagagagcccagcccatcagatggagccactggatcctgagccacgccgtggccctgaccagagacagcgagagactgctggaggtgagaaagagaatcaacgtgctgcccctgggcagcggcgccatcgccggcaaccccctgggcgtggacagagagctgctgagagccgagctgaacttcggcgccatcaccctgaacagcatggacgccaccagcgagagagacttcgtggccgagttcctgttctgggccagcctgtgcatgacccacctgagcagaatggccgaggacctgatcctgtactgcaccaaggagttcagcttcgtgcagctgagcgacgcctacagcaccggcagcagcctgatgccccagaagaagaaccccgacagcctggagctgatcagaagcaaggccggcagagtgttcggcagagaggacaaggaggccgtgttcgaggtgagcgacaccatgagcgccgtgctgcaggtggccaccggcgtgatcagcaccctgcagatccaccaggagaacatgggccaggccctgagccccgacatgctggccaccgacctggcctactacctggtgagaaagggcatgcccttcagacaggcccacgaggccagcggcaaggccgtgttcatggccgagaccaagggcgtggccctgaaccagctgagcctgcaggagctgcagaccatcagccccctgttcagcggcgacgtgatctgcgtgtgggactacggccacagcgtggagcagtacggcgccctgggcggcaccgccagaagcagcgtggactggcagatcagacaggtgagagccctgctgcaggcccagcaggcctag

SEQ ID NO: 1732 - DNA, 1395 bp, Artificial Sequence; identical to SEQ ID NO: 1729
  Description of Artificial Sequence: Synthetic coding sequence

SEQ ID NO: 1733 - DNA, 297 bp, Artificial Sequence
  Description of Artificial Sequence: Synthetic coding sequence
atggagaagttcaacgccagcatcgcctacgacagacacctgtgggaggtggacgtgcagggcagcaaggcctacagcagaggcctggagaaggccggcctgctgaccaaggccgagatggaccagatcctgcacggcctggacaaggtggccgaggagtgggcccagggcaccttcaagctgaacagcaacgacgaggacatccacaccgccaacgagagaagactgaaggagctgatcggcgccaccgccggcaagctgcacaccggcagaagcagaaacgaccaggtgctgtag

SEQ ID NO: 1734 - DNA, 1239 bp, Artificial Sequence
  Description of Artificial Sequence: Synthetic coding sequence
atgagcagcaagggcagcgtggtgctggcctacagcggcggcctggacaccagctgcatcctggtgtggctgaaggagcagggctacgacgtgatcgcctacctggccaacatcggccagaaggaggacttcgaggaggccagaaagaaggccctgaagctgggcgccaagaaggtgttcatcgaggacgtgagcagagagttcgtggaggagttcatctggcccgccatccagagcagcgccctgtacgaggacagatacctgctgggcaccagcctggccagaccctgcatcgccagaaagcaggtggagatcgcccagagagagggcgccaagtacgtgagccacggcgccaccggcaagggcaacgaccaggtgagattcgagctgagctgctacagcctggccccccagatcaaggtgatcgccccctggagaatgcccgagttctacaacagattcaagggcagaaacgacctgatggagtacgccaagcagcacggcatccccatccccgtgacccccaagaacccctggagcatggacgagaacctgatgcacatcagctacgaggccggcatcctggagaaccccaagaaccaggccccccccggcctgtacaccaagacccaggaccccgccaaggcccccaacacccccgacatcctggagatcgagttcaagaagggcgtgcccgtgaaggtgaccaacgtgaaggacggcaccacccaccagaccagcctggagctgttcatgtacctgaacgaggtggccggcaagcacggcgtgggcagaatcgacatcgtggagaacagattcatcggcatgaagagcagaggcatctacgagacccccgccggcaccatcctgtaccacgcccacctggacatcgaggccttcaccatggacagagaggtgagaaagatcaagcagggcctgggcctgaagttcgccgagctggtgtacaccggcttctggcacagccccgagtgcgagttcgtgagacactgcatcgccaagagccaggagagagtggagggcaaggtgcaggtgagcgtgctgaagggccaggtgtacatcctgggcagagagagccccctgagcctgtacaacgaggagctggtgagcatgaacgtgcagggcgactacgagcccaccgacgccaccggcttcatcaacatcaacagcctgagactgaaggagtaccacagactgcagagcaaggtgaccgccaagtag

SEQ ID NO: 1735 - DNA, 1239 bp, Artificial Sequence; identical to SEQ ID NO: 1734
  Description of Artificial Sequence: Synthetic coding sequence

SEQ ID NO: 1736 - DNA, 510 bp, Artificial Sequence
  Description of Artificial Sequence: Synthetic coding sequence
gagcccggccccctgcagctgatggtggtggccgaggcccagggcggcaagcacggcgtgggcagaatcgacatcgtggagaacagattcatcggcatgaagagcagaggcatctacgagacccccgccggcaccatcctgtaccacgcccacctggacatcgaggccttcaccatggacagagaggtgagaaagatcaagcagggcctgggcctgaagttcgccgagctggtgtacaccggcttctggcacagccccgagtgcgagttcgtgagacactgcatcgccaagagccaggagagagtggagggcaaggtgcaggtgagcgtgctgaagggccaggtgtacatcctgggcagagagagccccctgagcctgtacaacgaggagctggtgagcatgaacgtgcagggcgactacgagcccaccgacgccaccggcttcatcaacatcaacagcctgagactgaaggagtaccacagactgcagagcaaggtgaccgccaagtag

SEQ ID NO: 1737 - DNA, 1239 bp, Artificial Sequence; identical to SEQ ID NO: 1734
  Description of Artificial Sequence: Synthetic coding sequence

SEQ ID NO: 1738 - DNA, 1239 bp, Artificial Sequence; identical to SEQ ID NO: 1734
  Description of Artificial Sequence: Synthetic coding sequence

SEQ ID NO: 1739 - DNA, 597 bp, Artificial Sequence
  Description of Artificial Sequence: Synthetic coding sequence
atgagcagcaagggcagcgtggtgctggcctacagcggcggcctggacaccagctgcatcctggtgtggctgaaggagcagggctacgacgtgatcgcctacctggccaacatcggccagaaggaggacttcgaggaggccagaaagaaggccctgaagctgggcgccaagaaggtgttcatcgaggacgtgagcagagagttcgtggaggagttcatctggcccgccatccagagcagcgccctgtacgaggacagatacctgctgggcaccagcctggccagaccctgcatcgccagaaagcaggtggagatcgcccagagagagggcgccaagtacgtgagccacggcgccaccggcaagggcaacgaccaggtgagattcgagctgagctgctacagcctggccccccagatcaaggtgatcgccccctggagaatgcccgagttctacaacagattcaagggcagaaacgacctgatggagtacgccaagcagcacggcatccccatccccgtgacccccaagaacccctggagcatggacgagaacctgatgcacatcagctacgaggccggcatcctggagaacccctag

SEQ ID NO: 1740 - DNA, 540 bp, Artificial Sequence
  Description of Artificial Sequence: Synthetic coding sequence
atgagcagcaagggcagcgtggtgctggcctacagcggcggcctggacaccagctgcatcctggtgtggctgaaggagcagggctacgacgtgatcgcctacctggccaacatcggccagaaggaggacttcgaggaggccagaaagaaggccctgaagctgggcgccaagaaggtgttcatcgaggacgtgagcagagagttcgtggaggagttcatctggcccgccatccagagcagcgccctgtacgaggacagatacctgctgggcaccagcctggccagaccctgcatcgccagaaagcaggtggagatcgcccagagagagggcgccaagtacgtgagccacggcgccaccggcaaggtgatcgccccctggagaatgcccgagttctacaacagattcaagggcagaaacgacctgatggagtacgccaagcagcacggcatccccatccccgtgacccccaagaacccctggagcatggacgagaacctgatgcacatcagctacgaggccggcatcctggagaacccctag

SEQ ID NO: 1741 - DNA, 663 bp, Artificial Sequence
  Description of Artificial Sequence: Synthetic coding sequence
atggagctgggcctgggcggcctgagcaccctgagccactgcccctggcccagacagcagcccgccctgtggcccaccctggccgccctggccctgctgagcagcgtggccgaggccagcctgggcagcgcccccagaagccccgcccccagagagggccccccccccgtgctggccagccccgccggccacctgcccggcggcagaaccgccagatggtgcagcggcagagccagaagaccccccccccagcccagcagacccgccccccccccccccgccccccccagcgccctgcccagaggcggcagagccgccagagccggcggccccggcagcagagccagagccgccggcgccagaggctgcagactgagaagccagctggtgcccgtgagagccctgggcctgggccacagaagcgacgagctggtgagattcagattctgcagcggcagctgcagaagagccagaagcccccacgacctgagcctggccagcctgctgggcgccggcgccctgagacccccccccggcagcagacccgtgagccagccctgctgcagacccaccagatacgaggccgtgagcttcatggacgtgaacagcacctggagaaccgtggacagactgagcgccaccgcctgcggctgcctgggctag

SEQ ID NO: 1742 - DNA, 663 bp, Artificial Sequence; identical to SEQ ID NO: 1741
  Description of Artificial Sequence: Synthetic coding sequence

SEQ ID NO: 1743 - DNA, 687 bp, Artificial Sequence
  Description of Artificial Sequence: Synthetic coding sequence
atggagctgggcctgggcggcctgagcaccctgagccactgcccctggcccagacagcaggcccccctgggcctgagcgcccagcccgccctgtggcccaccctggccgccctggccctgctgagcagcgtggccgaggccagcctgggcagcgcccccagaagccccgcccccagagagggccccccccccgtgctggccagccccgccggccacctgcccggcggcagaaccgccagatggtgcagcggcagagccagaagaccccccccccagcccagcagacccgccccccccccccccgccccccccagcgccctgcccagaggcggcagagccgccagagccggcggccccggcagcagagccagagccgccggcgccagaggctgcagactgagaagccagctggtgcccgtgagagccctgggcctgggccacagaagcgacgagctggtgagattcagattctgcagcggcagctgcagaagagccagaagcccccacgacctgagcctggccagcctgctgggcgccggcgccctgagacccccccccggcagcagacccgtgagccagccctgctgcagacccaccagatacgaggccgtgagcttcatggacgtgaacagcacctggagaaccgtggacagactgagcgccaccgcctgcggctgcctgggctag

SEQ ID NO: 1744 - DNA, 201 bp, Artificial Sequence
  Description of Artificial Sequence: Synthetic coding sequence
atggagctgggcctgggcggcctgagcaccctgagccactgcccctggcccagacagcagcccgccctgtggcccaccctggccgccctggccctgctgagcagcgtggccgaggccagcctgggcagcgcccccagaagccccgcccccagagagggccccccccccgtgctggccagccccgccggccacctgccctag

SEQ ID NO: 1745 - DNA, 270 bp, Artificial Sequence
  Description of Artificial Sequence: Synthetic coding sequence
atggagctgggcctgggcggcctgagcaccctgagccactgcccctggcccagacagcaggcccccctgggcctgagcgcccagcccgccctgtggcccaccctggccgccctggccctgctgagcagcgtggccgaggccagcctgggcagcgcccccagaagccccgcccccagagagggccccccccccgtgctggccagccccgccggccacctgcccggcggcagaaccgccagatggtgcagcggcagagccagaagaccctag

SEQ ID NO: 1746 - DNA, 201 bp, Artificial Sequence; identical to SEQ ID NO: 1744
  Description of Artificial Sequence: Synthetic coding sequence

SEQ ID NO: 1747 - DNA, 270 bp, Artificial Sequence; identical to SEQ ID NO: 1745
  Description of Artificial Sequence: Synthetic coding sequence

SEQ ID NO: 1748 - DNA, 687 bp, Artificial Sequence; identical to SEQ ID NO: 1743
  Description of Artificial Sequence: Synthetic coding sequence

SEQ ID NO: 1749 - DNA, 1602 bp, Artificial Sequence
  Description of Artificial Sequence: Synthetic coding sequence
atgggccccagaggcgccgccagcctgcccagaggccccggccccagaagactgctgctgcccgtggtgctgcccctgctgctgctgctgctgctggccccccccggcagcggcgccggcgccagcagacccccccacctggtgttcctgctggccgacgacctgggctggaacgacgtgggcttccacggcagcagaatcagaaccccccacctggacgccctggccgccggcggcgtgctgctggacaactactacacccagcccctgtgcacccccagcagaagccagctgctgaccggcagataccagatcagaaccggcctgcagcaccagatcatctggccctgccagcccagctgcgtgcccctggacgagaagctgctgccccagctgctgaaggaggccggctacaccacccacatggtgggcaagtggcacctgggcatgtacagaaaggagtgcctgcccaccagaagaggcttcgacacctacttcggctacctgctgggcagcgaggactactacagccacgagagatgcaccctgatcgacgccctgaacgtgaccagatgcgccctggacttcagagacggcgaggaggtggccaccggctacaagaacatgtacagcaccaacatcttcaccaagagagccatcgccctgatcaccaaccacccccccgagaagcccctgttcctgtacctggccctgcagagcgtgcacgagcccctgcaggtgcccgaggagtacctgaagccctacgacttcatccaggacaagaacagacaccactacgccggcatggtgagcctgatggacgaggccgtgggcaacgtgaccgccgccctgaagagcagcggcctgtggaacaacaccgtgttcatcttcagcaccgacaacggcggccagaccctggccggcggcaacaactggcccctgagaggcagaaagtggagcctgtgggagggcggcgtgagaggcgtgggcttcgtggccagccccctgctgaagcagaagggcgtgaagaacagagagctgatccacatcagcgactggctgcccaccctggtgaagctggccagaggccacaccaacggcaccaagcccctggacggcttcgacgtgtggaagaccatcagcgagggcagccccagccccagaatcgagctgctgcacaacatcgaccccaacttcgtggacagcagcccctgccccagaaacagcatggcccccgccaaggacgacagcagcctgcccgagtacagcgccttcaacaccagcgtgcacgccgccatcagacacggcaactggaagctgctgaccggctaccccggctgcggctactggttccccccccccagccagtacaacgtgagcgagatccccagcagcgacccccccaccaagaccctgtggctgttcgacatcgacagagaccccgaggagagacacgacctgagcagagagtacccccacatcgtgaccaagctgctgagcagactgcagttctaccacaagcacagcgtgcccgtgtacttccccgcccaggaccccagatgcgaccccaaggccaccggcgtgtggggcccctggatgtag

SEQ ID NO: 1750 - DNA, 1602 bp, Artificial Sequence; identical to SEQ ID NO: 1749
  Description of Artificial Sequence: Synthetic coding sequence

SEQ ID NO: 1751 - DNA, 1242 bp, Artificial Sequence
  Description of Artificial Sequence: Synthetic coding sequence
atgggccccagaggcgccgccagcctgcccagaggccccggccccagaagactgctgctgcccgtggtgctgcccctgctgctgctgctgctgctggccccccccggcagcggcgccggcgccagcagacccccccacctggtgttcctgctggccgacgacctgggctggaacgacgtgggcttccacggcagcagaatcagaaccccccacctggacgccctggccgccggcggcgtgctgctggacaactactacacccagcccctgtgcacccccagcagaagccagctgctgaccggcagataccagatcagaaccggcctgcagcaccagatcatctggccctgccagcccagctgcgtgcccctggacgagaagctgctgccccagctgctgaaggaggccggctacaccacccacatggtgggcaagtggcacctgggcatgtacagaaaggagtgcctgcccaccagaagaggcttcgacacctacttcggctacctgctgggcagcgaggactactacagccacgagagatgcaccctgatcgacgccctgaacgtgaccagatgcgccctggacttcagagacggcgaggaggtggccaccggctacaagaacatgtacagcaccaacatcttcaccaagagagccatcgccctgatcaccaaccacccccccgagaagcccctgttcctgtacctggccctgcagagcgtgcacgagcccctgcaggtgcccgaggagtacctgaagccctacgacttcatccaggacaagaacagacaccactacgccggcatggtgagcctgatggacgaggccgtgggcaacgtgaccgccgccctgaagagcagcggcctgtggaacaacaccgtgttcatcttcagcaccgacaacggcggccagaccctggccggcggcaacaactggcccctgagaggcagaaagtggagcctgtgggagggcggcgtgagaggcgtgggcttcgtggccagccccctgctgaagcagaagggcgtgaagaacagagagctgatccacatcagcgactggctgcccaccctggtgaagctggccagaggccacaccaacggcaccaagcccctggacggcttcgacgtgtggaagaccatcagcgagggcagccccagccccagaatcgagctgctgcacaacatcgaccccaacttcgtggacagcagcccctactggcccgagtgcagcctgctgctgtag

SEQ ID NO: 1752 - DNA, 138 bp, Artificial Sequence
  Description of Artificial Sequence: Synthetic coding sequence
atgggccccagaggcgccgccagcctgcccagaggccccggccccagaagactgctgctgcccgtggtgctgcccctgctgctgctgctgctgctggccccccccggcagcggcgccggcgccagcagacccccctag

SEQ ID NO: 1753 - DNA, 1788 bp, Artificial Sequence
  Description of Artificial Sequence: Synthetic coding sequence
atggccggccccagcccccccctgagagccggcgtgggcagaagactgctgggcgtggcccaccccgacctgagaccctgcctgtgcggcgagctgcaggtggagggcggccccggccccgtgcccggcatgctgagaacctgctacgtgagaagcccctggagaagaggccccagcagcgccagaggcgagcagagcggcagcggccacctggagcaggaggaggtgcagagcggcagcctgctgttcagactgctgctgttcctgagcagaagccccgccagcagaaaccagagaatcctgtacaccgtgctggagtgccagcccctgttcgacagcagcgacatgaccatcgccgagtgggtgtgcctggcccagaccatcaagagacactacgagcagtaccacggcttcgtggtgatccacggcaccgacaccatggccttcgccgccagcatgctgagcttcatgctggagaacctgcagaagaccgtgatcctgaccggcgcccaggtgcccatccacgccctgtggagcgacggcagagagaacctgctgggcgccctgctgatggccggccagtacgtgatccccgaggtgtgcctgttcttccagaaccagctgttcagaggcaacagagccaccaaggtggacgccagaagattcgccgccttctgcagccccaacctgctgcccctggccaccgtgggcgccgacatcaccatcaacagagagctggtgagaaaggtggacggcaaggccggcctggtggtgcacagcagcatggagcaggacgtgggcctgctgagactgtaccccggcatccccgccgccctggtgagagccttcctgcagccccccctgaagggcgtggtgatggagaccttcggcagcggcaacggccccaccaagcccgacctgctgcaggagctgagagtggccaccgagagaggcctggtgatcgtgaactgcacccactgcctgcagggcgccgtgaccaccgactacgccgccggcatggccatggccggcgccggcgtgatcagcggcttcgacatgaccagcgaggccgccctggccaagctgagctacgtgctgggccagcccggcctgagcctggacgtgagaaaggagctgctgaccaaggacctgagaggcgagatgaccccccccagcgtggaggagagaagacccagcctgcagggcaacaccctgggcggcggcgtgagctggctgctgagcctgagcggcagccaggaggccgacgccctgagaaacgccctggtgcccagcctggcctgcgccgccgcccacgccggcgacgtggaggccctgcaggccctggtggagctgggcagcgacctgggcctggtggacttcaacggccagacccccctgcacgccgccgccagaggcggccacaccgaggccgtgaccatgctgctgcagagaggcgtggacgtgaacaccagagacaccgacggcttcagccccctgctgctggccgtgagaggcagacaccccggcgtgatcggcctgctgagagaggccggcgccagcctgagcacccaggagctggaggaggccggcaccgagctgtgcagactggcctacagagccgacctggagggcctgcaggtgtggtggcaggccggcgccgacctgggccagcccggctacgacggccacagcgccctgcacgtggccgaggccgccggcaacctggccgtggtggccttcctgcagagcctggagggcgccgtgggcgcccaggccccctgcccctag

SEQ ID NO: 1754 - DNA, 1740 bp, Artificial Sequence
  Description of Artificial Sequence: Synthetic coding sequence
atggccagagccgtgggccccgagagaagactgctggccgtgtacaccggcggcaccatcggcatgagaagcgagctgggcgtgctggtgcccggcaccggcctggccgccatcctgagaaccctgcccatgttccacgacgaggagcacgccagagccagaggcctgagcgaggacaccctggtgctgccccccgccagcagaaaccagagaatcctgtacaccgtgctggagtgccagcccctgttcgacagcagcgacatgaccatcgccgagtgggtgtgcctggcccagaccatcaagagacactacgagcagtaccacggcttcgtggtgatccacggcaccgacaccatggccttcgccgccagcatgctgagcttcatgctggagaacctgcagaagaccgtgatcctgaccggcgcccaggtgcccatccacgccctgtggagcgacggcagagagaacctgctgggcgccctgctgatggccggccagtacgtgatccccgaggtgtgcctgttcttccagaaccagctgttcagaggcaacagagccaccaaggtggacgccagaagattcgccgccttctgcagccccaacctgctgcccctggccaccgtgggcgccgacatcaccatcaacagagagctggtgagaaaggtggacggcaaggccggcctggtggtgcacagcagcatggagcaggacgtgggcctgctgagactgtaccccggcatccccgccgccctggtgagagccttcctgcagccccccctgaagggcgtggtgatggagaccttcggcagcggcaacggccccaccaagcccgacctgctgcaggagctgagagtggccaccgagagaggcctggtgatcgtgaactgcacccactgcctgcagggcgccgtgaccaccgactacgccgccggcatggccatggccggcgccggcgtgatcagcggcttcgacatgaccagcgaggccgccctggccaagctgagctacgtgctgggccagcccggcctgagcctggacgtgagaaaggagctgctgaccaaggacctgagaggcgagatgaccccccccagcgtggaggagagaagacccagcctgcagggcaacaccctgggcggcggcgtgagctggctgctgagcctgagcggcagccaggaggccgacgccctgagaaacgccctggtgcccagcctggcctgcgccgccgcccacgccggcgacgtggaggccctgcaggccctggtggagctgggcagcgacctgggcctggtggacttcaacggccagacccccctgcacgccgccgccagaggcggccacaccgaggccgtgaccatgctgctgcagagaggcgtggacgtgaacaccagagacaccgacggcttcagccccctgctgctggccgtgagaggcagacaccccggcgtgatcggcctgctgagagaggccggcgccagcctgagcacccaggagctggaggaggccggcaccgagctgtgcagactggcctacagagccgacctggagggcctgcaggtgtggtggcaggccggcgccgacctgggccagcccggctacgacggccacagcgccctgcacgtggccgaggccgccggcaacctggccgtggtggccttcctgcagagcctggagggcgccgtgggcgcccaggccccctgccccgagcccagctgcttccaggaggtgctgcccggcgtgtag

SEQ ID NO: 1755 - DNA, 423 bp, Artificial Sequence
  Description of Artificial Sequence: Synthetic coding sequence
gccgccgccagaggcggccacaccgaggccgtgaccatgctgctgcagagaggcgtggacgtgaacaccagagacaccgacggcttcagccccctgctgctggccgtgagaggcagacaccccggcgtgatcggcctgctgagagaggccggcgccagcctgagcacccaggagctggaggaggccggcaccgagctgtgcagactggcctacagagccgacctggagggcctgcaggtgtggtggcaggccggcgccgacctgggccagcccggctacgacggccacagcgccctgcacgtggccgaggccgccggcaacctggccgtggtggccttcctgcagagcctggagggcgccgtgggcgcccaggccccctgccccgagcccagctgcttccaggaggtgctgcccggcgtgtag

SEQ ID NO: 1756 - DNA, 1722 bp, Artificial Sequence
  Description of Artificial Sequence: Synthetic coding sequence
atggccagagccgtgggccccgagagaagactgctggccgtgtacaccggcggcaccatcggcatgagaagcgagctgggcgtgctggtgcccggcaccggcctggccgccatcctgagaaccctgcccatgttccacgacgaggagcacgccagagccagaggcctgagcgaggacaccctggtgctgccccccgccagcagaaaccagagaatcctgtacaccgtgctggagtgccagcccctgttcgacagcagcgacatgaccatcgccgagtgggtgtgcctggcccagaccatcaagagacactacgagcagtaccacggcttcgtggtgatccacggcaccgacaccatggccttcgccgccagcatgctgagcttcatgctggagaacctgcagaagaccgtgatcctgaccggcgcccaggtgcccatccacgccctgtggagcgacggcagagagaacctgctgggcgccctgctgatggccggccagtacgtgatccccgaggtgtgcctgttcttccagaaccagctgttcagaggcaacagagccaccaaggtggacgccagaagattcgccgccttctgcagccccaacctgctgcccctggccaccgtgggcgccgacatcaccatcaacagagagctggtgagaaaggtggacggcaaggccggcctggtggtgcacagcagcatggagcaggacgtgggcctgctgagactgtaccccggcatccccgccgccctggtgagagccttcctgcagccccccctgaagggcgtggtgatggagaccttcggcagcggcaacggccccaccaagcccgacctgctgcaggagctgagagtggccaccgagagaggcctggtgatcgtgaactgcacccactgcctgcagggcgccgtgaccaccgactacgccgccggcatggccatggccggcgccggcgtgatcagcggcttcgacatgaccagcgaggccgccctggccaagctgagctacgtgctgggccagcccggcctgagcctggacgtgagaaaggagctgctgaccaaggacctgagaggcgagatgaccccccccagcgtggaggagagaagacccagcctgcagggcaacaccctgggcggcggcgtgagctggctgctgagcctgagcggcagccaggaggccgacgccctgagaaacgccctggtgcccagcctggcctgcgccgccgcccacgccggcgacgtggaggccctgcaggccctggtggagctgggcagcgacctgggcctggtggacttcaacggccagacccccctgcacgccgccgccagaggcggccacaccgaggccgtgaccatgctgctgcagagaggcgtggacgtgaacaccagagacaccgacggcttcagccccctgctgctggccgtgagaggcagacaccccggcgtgatcggcctgctgagagaggccggcgccagcctgagcacccaggagctggaggaggccggcaccgagctgtgcagactggcctacagagccgacctggagggcctgcaggtgtggtggcaggccggcgccgacctgggccagcccggctacgacggccacagcgccctgcacgtggccgaggccgccggcaacctggccgtggtggccttcctgcagagcctggagggcgccgtgggcgcccaggccccctgccccgaggtgctgcccggcgtgtag

SEQ ID NO: 1757 - DNA, 942 bp, Artificial Sequence
  Description of Artificial Sequence: Synthetic coding sequence
atgaccagctgccacatcgccgaggagcacatccagaaggtggccatcttcggcggcacccacggcaacgagctgaccggcgtgttcctggtgaagcactggctggagaacggcgccgagatccagagaaccggcctggaggtgaagcccttcatcaccaaccccagagccgtgaagaagtgcaccagatacatcgactgcgacctgaacagaatcttcgacctggagaacctgggcaagaagatgagcgaggacctgccctacgaggtgagaagagcccaggagatcaaccacctgttcggccccaaggacagcgaggacagctacgacatcatcttcgacctgcacaacaccaccagcaacatgggctgcaccctgatcctggaggacagcagaaacaacttcctgatccagatgttccactacatcaagaccagcctggcccccctgccctgctacgtgtacctgatcgagcaccccagcctgaagtacgccaccaccagaagcatcgccaagtaccccgtgggcatcgaggtgggcccccagccccagggcgtgctgagagccgacatcctggaccagatgagaaagatgatcaagcacgccctggacttcatccaccacttcaacgagggcaaggagttccccccctgcgccatcgaggtgtacaagatcatcgagaaggtggactaccccagagacgagaacggcgagatcgccgccatcatccaccccaacctgcaggaccaggactggaagcccctgcaccccggcgaccccatgttcctgaccctggacggcaagaccatccccctgggcggcgactgcaccgtgtaccccgtgttcgtgaacgaggccgcctactacgagaagaaggaggccttcgccaagaccaccaagctgaccctgaacgccaagagcatcagatgctgcctgcactag

SEQ ID NO: 1758 - DNA, 942 bp, Artificial Sequence; identical to SEQ ID NO: 1757
  Description of Artificial Sequence: Synthetic coding sequence

SEQ ID NO: 1759 - DNA, 3756 bp, Artificial Sequence
  Description of Artificial Sequence: Synthetic coding sequence
atgagcaccgagagagacagcgagaccaccttcgacgaggacagccagcccaacgacgaggtggtgccctacagcgacgacgagaccgaggacgagctggacgaccagggcagcgccgtggagcccgagcagaacagagtgaacagagaggccgaggagaacagagagcccttcagaaaggagtgcacctggcaggtgaaggccaacgacagaaagtaccacgagcagccccacttcatgaacaccaagttcctgtgcatcaaggagagcaagtacgccaacaacgccatcaagacctacaagtacaacgccttcaccttcatccccatgaacctgttcgagcagttcaagagagccgccaacctgtacttcctggccctgctgatcctgcaggccgtgccccagatcagcaccctggcctggtacaccaccctggtgcccctgctggtggtgctgggcgtgaccgccatcaaggacctggtggacgacgtggccagacacaagatggacaaggagatcaacaacagaacctgcgaggtgatcaaggacggcagattcaaggtggccaagtggaaggagatccaggtgggcgacgtgatcagactgaagaagaacgacttcgtgcccgccgacatcctgctgctgagcagcagcgagcccaacagcctgtgctacgtggagaccgccgagctggacggcgagaccaacctgaagttcaagatgagcctggagatcaccgaccagtacctgcagagagaggacaccctggccaccttcgacggcttcatcgagtgcgaggagcccaacaacagactggacaagttcaccggcaccctgttctggagaaacaccagcttccccctggacgccgacaagatcctgctgagaggctgcgtgatcagaaacaccgacttctgccacggcctggtgatcttcgccggcgccgacaccaagatcatgaagaacagcggcaagaccagattcaagagaaccaagatcgactacctgatgaactacatggtgtacaccatcttcgtggtgctgatcctgctgagcgccggcctggccatcggccacgcctactgggaggcccaggtgggcaacagcagctggtacctgtacgacggcgaggacgacacccccagctacagaggcttcctgatcttctggggctacatcatcgtgctgaacaccatggtgcccatcagcctgtacgtgagcgtggaggtgatcagactgggccagagccacttcatcaactgggacctgcagatgtactacgccgagaaggacacccccgccaaggccagaaccaccaccctgaacgagcagctgggccagatccactacatcttcagcgacaagaccggcaccctgacccagaacatcatgaccttcaagaagtgctgcatcaacggccagatctacggcgaccacagagacgccagccagcacaaccacaacaagatcgagcaggtggacttcagctggaacacctacgccgacggcaagctggccttctacgaccactacctgatcgagcagatccagagcggcaaggagcccgaggtgagacagttcttcttcctgctggccgtgtgccacaccgtgatggtggacagaaccgacggccagctgaactaccaggccgccagccccgacgagggcgccctggtgaacgccgccagaaacttcggcttcgccttcctggccagaacccagaacaccatcaccatcagcgagctgggcaccgagagaacctacaacgtgctggccatcctggacttcaacagcgacagaaagagaatgagcatcatcgtgagaacccccgagggcaacatcaagctgtactgcaagggcgccgacaccgtgatctacgagagactgcacagaatgaaccccaccaagcaggagacccaggacgccctggacatcttcgccaacgagaccctgagaaccctgtgcctgtgctacaaggagatcgaggagaaggagttcaccgagtggaacaagaagttcatggccgccagcgtggccagcaccaacagagacgaggccctggacaaggtgtacgaggagatcgagaaggacctgatcctgctgggcgccaccgccatcgaggacaagctgcaggacggcgtgcccgagaccatcagcaagctggccaaggccgacatcaagatctgggtgctgaccggcgacaagaaggagaccgccgagaacatcggcttcgcctgcgagctgctgaccgaggacaccaccatctgctacggcgaggacatcaacagcctgctgcacgccagaatggagaaccagagaaacagaggcggcgtgtacgccaagttcgccccccccgtgcaggagagcttcttcccccccggcggcaacagagccctgatcatcaccggcagctggctgaacgagatcctgctggagaagaagaccaagagaaacaagatcctgaagctgaagttccccagaaccgaggaggagagaagaatgagaacccagagcaagagaagactggaggccaagaaggagcagagacagaagaacttcgtggacctggcctgcgagtgcagcgccgtgatctgctgcagagtgacccccaagcagaaggccatggtggtggacctggtgaagagatacaagaaggccatcaccctggccatcggcgacggcgccaacgacgtgaacatgatcaagaccgcccacatcggcgtgggcatcagcggccaggagggcatgcaggccgtgatgagcagcgactacagcttcgcccagttcagatacctgcagagactgctgctggtgcacggcagatggagctacatcagaatgtgcaagttcctgagatacttcttctacaagaacttcgccttcaccctggtgcacttctggtacagcttcttcaacggctacagcgcccagaccgcctacgaggactggttcatcaccctgtacaacgtgctgtacaccagcctgcccgtgctgctgatgggcctgctggaccaggacgtgagcgacaagctgagcctgagattccccggcctgtacatcgtgggccagagagacctgctgttcaactacaagagattcttcgtgagcctgctgcacggcgtgctgaccagcatgatcctgttcttcatccccctgggcgcctacctgcagaccgtgggccaggacggcgaggcccccagcgactaccagagcttcgccgtgaccatcgccagcgccctggtgatcaccgtgaacttccagatcggcctggacaccagctactggaccttcgtgaacgccttcagcatcttcggcagcatcgccctgtacttcggcatcatgttcgacttccacagcgccggcatccacgtgctgttccccagcgccttccagttcaccggcaccgccagcaacgccctgagacagccctacatctggctgaccatcatcctggccgtggccgtgtgcctgctgcccgtggtggccatcagattcctgagcatgaccatctggcccagcgagagcgacaagatccagaagcacagaaagagactgaaggccgaggagcagtggcagagaagacagcaggtgttcagaagaggcgtgagcaccagaagaagcgcctacgccttcagccaccagagaggctacgccgacctgatcagcagcggcagaagcatcagaaagaagagaagccccctggacgccatcgtggccgacggcaccgccgagtacagaagaaccggcgacagctag

SEQ ID NO: 1760 - DNA, 3756 bp, Artificial Sequence; identical to SEQ ID NO: 1759
  Description of Artificial Sequence: Synthetic coding sequence

SEQ ID NO: 1761 - DNA, 4398 bp, Artificial Sequence
  Description of Artificial Sequence: Synthetic coding sequence
atgcccgagcaggagagacagatcaccgccagagagggcgccagcagaaagatcctgagcaagctgagcctgcccaccagagcctgggagcccgccatgaagaagagcttcgccttcgacaacgtgggctacgagggcggcctggacggcctgggccccagcagccaggtggccaccagcaccgtgagaatcctgggcatgacctgccagagctgcgtgaagagcatcgaggacagaatcagcaacctgaagggcatcatcagcatgaaggtgagcctggagcagggcagcgccaccgtgaagtacgtgcccagcgtggtgtgcctgcagcaggtgtgccaccagatcggcgacatgggcttcgaggccagcatcgccgagggcaaggccgccagctggcccagcagaagcctgcccgcccaggaggccgtggtgaagctgagagtggagggcatgacctgccagagctgcgtgagcagcatcgagggcaaggtgagaaagctgcagggcgtggtgagagtgaaggtgagcctgagcaaccaggaggccgtgatcacctaccagccctacctgatccagcccgaggacctgagagaccacgtgaacgacatgggcttcgaggccgccatcaagagcaaggtggcccccctgagcctgggccccatcgacatcgagagactgcagagcaccaaccccaagagacccctgagcagcgccaaccagaacttcaacaacagcgagaccctgggccaccagggcagccacgtggtgaccctgcagctgagaatcgacggcatgcactgcaagagctgcgtgctgaacatcgaggagaacatcggccagctgctgggcgtgcagagcatccaggtgagcctggagaacaagaccgcccaggtgaagtacgaccccagctgcaccagccccgtggccctgcagagagccatcgaggccctgccccccggcaacttcaaggtgagcctgcccgacggcgccgagggcagcggcaccgaccacagaagcagcagcagccacagccccggcagcccccccagaaaccaggtgcagggcacctgcagcaccaccctgatcgccatcgccggcatgacctgcgccagctgcgtgcacagcatcgagggcatgatcagccagctggagggcgtgcagcagatcagcgtgagcctggccgagggcaccgccaccgtgctgtacaaccccagcgtgatcagccccgaggagctgagagccgccatcgaggacatgggcttcgaggccagcgtggtgagcgagagctgcagcaccaaccccctgggcaaccacagcgccggcaacagcatggtgcagaccaccgacggcacccccaccagcgtgcaggaggtggccccccacaccggcagactgcccgccaaccacgcccccgacatcctggccaagagcccccagagcaccagagccgtggccccccagaagtgcttcctgcagatcaagggcatgacctgcgccagctgcgtgagcaacatcgagagaaacctgcagaaggaggccggcgtgctgagcgtgctggtggccctgatggccggcaaggccgagatcaagtacgaccccgaggtgatccagcccctggagatcgcccagttcatccaggacctgggcttcgaggccgccgtgatggaggactacgccggcagcgacggcaacatcgagctgaccatcaccggcatgacctgcgccagctgcgtgcacaacatcgagagcaagctgaccagaaccaacggcatcacctacgccagcgtggccctggccaccagcaaggccctggtgaagttcgaccccgagatcatcggccccagagacatcatcaagatcatcgaggagatcggcttccacgccagcctggcccagagaaaccccaacgcccaccacctggaccacaagatggagatcaagcagtggaagaagagcttcctgtgcagcctggtgttcggcatccccgtgatggccctgatgatctacatgctgatccccagcaacgagccccaccagagcatggtgctggaccacaacatcatccccggcctgagcatcctgaacctgatcttcttcatcctgtgcaccttcgtgcagctgctgggcggctggtacttctacgtgcaggcctacaagagcctgagacacagaagcgccaacatggacgtgctgatcgtgctggccaccagcatcgcctacgtgtacagcctggtgatcctggtggtggccgtggccgagaaggccgagagaagccccgtgaccttcttcgacaccccccccatgctgttcgtgttcatcgccctgggcagatggctggagcacctggccaagagcaagaccagcgaggccctggccaagctgatgagcctgcaggccaccgaggccaccgtggtgaccctgggcgaggacaacctgatcatcagagaggagcaggtgcccatggagctggtgcagagaggcgacatcgtgaaggtggtgcccggcggcaagttccccgtggacggcaaggtgctggagggcaacaccatggccgacgagagcctgatcaccggcgaggccatgcccgtgaccaagaagcccggcagcaccgtgatcgccggcagcatcaacgcccacggcagcgtgctgatcaaggccacccacgtgggcaacgacaccaccctggcccagatcgtgaagctggtggaggaggcccagatgagcaaggcccccatccagcagctggccgacagattcagcggctacttcgtgcccttcatcatcatcatgagcaccctgaccctggtggtgtggatcgtgatcggcttcatcgacttcggcgtggtgcagagatacttccccaaccccaacaagcacatcagccagaccgaggtgatcatcagattcgccttccagaccagcatcaccgtgctgtgcatcgcctgcccctgcagcctgggcctggccacccccaccgccgtgatggtgggcaccggcgtggccgcccagaacggcatcctgatcaagggcggcaagcccctggagatggcccacaagatcaagaccgtgatgttcgacaagaccggcaccatcacccacggcgtgcccagagtgatgagagtgctgctgctgggcgacgtggccaccctgcccctgagaaaggtgctggccgtggtgggcaccgccgaggccagcagcgagcaccccctgggcgtggccgtgaccaagtactgcaaggaggagctgggcaccgagaccctgggctactgcaccgacttccaggccgtgcccggctgcggcatcggctgcaaggtgagcaacgtggagggcatcctggcccacagcgagagacccctgagcgcccccgccagccacctgaacgaggccggcagcctgcccgccgagaaggacgccgtgccccagaccttcagcgtgctgatcggcaacagagagtggctgagaagaaacggcctgaccatcagcagcgacgtgagcgacgccatgaccgaccacgagatgaagggccagaccgccatcctggtggccatcgacggcgtgctgtgcggcatgatcgccatcgccgacgccgtgaagcaggaggccgccctggccgtgcacaccctgcagagcatgggcgtggacgtggtgctgatcaccggcgacaacagaaagaccgccagagccatcgccacccaggtgggcatcaacaaggtgttcgccgaggtgctgcccagccacaaggtggccaaggtgcaggagctgcagaacaagggcaagaaggtggccatggtgggcgacggcgtgaacgacagccccgccctggcccaggccgacatgggcgtggccatcggcaccggcaccgacgtggccatcgaggccgccgacgtggtgctgatcagaaacgacctgctggacgtggtggccagcatccacctgagcaagagaaccgtgagaagaatcagaatcaacctggtgctggccctgatctacaacctggtgggcatccccatcgccgccggcgtgttcatgcccatcggcatcgtgctgcagccctggatgggcagcgccgccatggccgccagcagcgtgagcgtggtgctgagcagcctgcagctgaagtgctacaagaagcccgacctggagagatacgaggcccaggcccacggccacatgaagcccctgaccgccagccaggtgagcgtgcacatcggcatggacgacagatggagagacagccccagagccaccccctgggaccaggtgagctacgtgagccaggtgagcctgagcagcctgaccagcgacaagcccagcagacacagcgccgccgccgacgacgacggcgacaagtggagcctgctgctgaacggcagagacgaggagcagtacatctag

SEQ ID NO: 1762 - DNA, 3777 bp, Artificial Sequence
  Description of Artificial Sequence: Synthetic coding sequence
atgcccgagcaggagagacagatcaccgccagagagggcgccagcagaaagatcctgagcaagctgagcctgcccaccagagcctgggagcccgccatgaagaagagcttcgccttcgacaacgtgggctacgagggcggcctggacggcctgggccccagcagccaggtggccaccagcaccgtgagaatcctgggcatgacctgccagagctgcgtgaagagcatcgaggacagaatcagcaacctgaagggcatcatcagcatgaaggtgagcctggagcagggcagcgccaccgtgaagtacgtgcccagcgtggtgtgcctgcagcaggtgtgccaccagatcggcgacatgggcttcgaggccagcatcgccgagggcaaggccgccagctggcccagcagaagcctgcccgcccaggaggccgtggtgaagctgagagtggagggcatgacctgccagagctgcgtgagcagcatcgagggcaaggtgagaaagctgcagggcgtggtgagagtgaaggtgagcctgagcaaccaggaggccgtgatcacctaccagccctacctgatccagcccgaggacctgagagaccacgtgaacgacatgggcttcgaggccgccatcaagagcaaggtggcccccctgagcctgggccccatcgacatcgagagactgcagagcaccaaccccaagagacccctgagcagcgccaaccagaacttcaacaacagcgagaccctgggccaccagggcagccacgtggtgaccctgcagctgagaatcgacggcatgcactgcaagagctgcgtgctgaacatcgaggagaacatcggccagctgctgggcgtgcagagcatccaggtgagcctggagaacaagaccgcccaggtgaagtacgaccccagctgcaccagccccgtggccctgcagagagccatcgaggccctgccccccggcaacttcaaggtgagcctgcccgacggcgccgagggcagcggcaccgaccacagaagcagcagcagccacagccccggcagcccccccagaaaccaggtgcagggcacctgcagcaccaccctgatcgccatcgccggcatgacctgcgccagctgcgtgcacagcatcgagggcatgatcagccagctggagggcgtgcagcagatcagcgtgagcctggccgagggcaccgccaccgtgctgtacaaccccagcgtgatcagccccgaggagctgagagccgccatcgaggacatgggcttcgaggccagcgtggtgagcgagagctgcagcaccaaccccctgggcaaccacagcgccggcaacagcatggtgcagaccaccgacggcacccccaccagcgtgcaggaggtggccccccacaccggcagactgcccgccaaccacgcccccgacatcctggccaagagcccccagagcaccagagccgtggccccccagaagtgcttcctgcagatcaagggcatgacctgcgccagctgcgtgagcaacatcgagagaaacctgcagaaggaggccggcgtgctgagcgtgctggtggccctgatggccggcaaggccgagatcaagtacgaccccgaggtgatccagcccctggagatcgcccagttcatccaggacctgggcttcgaggccgccgtgatggaggactacgccggcagcgacggcaacatcgagctgaccatcaccggcatgacctgcgccagctgcgtgcacaacatcgagagcaagctgaccagaaccaacggcatcacctacgccagcgtggccctggccaccagcaaggccctggtgaagttcgaccccgagatcatcggccccagagacatcatcaagatcatcgagagcaagaccagcgaggccctggccaagctgatgagcctgcaggccaccgaggccaccgtggtgaccctgggcgaggacaacctgatcatcagagaggagcaggtgcccatggagctggtgcagagaggcgacatcgtgaaggtggtgcccggcggcaagttccccgtggacggcaaggtgctggagggcaacaccatggccgacgagagcctgatcaccggcgaggccatgcccgtgaccaagaagcccggcagcaccgtgatcgccggcagcatcaacgcccacggcagcgtgctgatcaaggccacccacgtgggcaacgacaccaccctggcccagatcgtgaagctggtggaggaggcccagatgagcaagaaccccaacaagcacatcagccagaccgaggtgatcatcagattcgccttccagaccagcatcaccgtgctgtgcatcgcctgcccctgcagcctgggcctggccacccccaccgccgtgatggtgggcaccggcgtggccgcccagaacggcatcctgatcaagggcggcaagcccctggagatggcccacaagatcaagaccgtgatgttcgacaagaccggcaccatcacccacggcgtgcccagagtgatgagagtgctgctgctgggcgacgtggccaccctgcccctgagaaaggtgctggccgtggtgggcaccgccgaggccagcagcgagcaccccctgggcgtggccgtgaccaagtactgcaaggaggagctgggcaccgagaccctgggctactgcaccgacttccaggccgtgcccggctgcggcatcggctgcaaggtgagcaacgtggagggcatcctggcccacagcgagagacccctgagcgcccccgccagccacctgaacgaggccggcagcctgcccgccgagaaggacgccgtgccccagaccttcagcgtgctgatcggcaacagagagtggctgagaagaaacggcctgaccatcagcagcgacgtgagcgacgccatgaccgaccacgagatgaagggccagaccgccatcctggtggccatcgacggcgtgctgtgcggcatgatcgccatcgccgacgccgtgaagcaggaggccgccctggccgtgcacaccctgcagagcatgggcgtggacgtggtgctgatcaccggcgacaacagaaagaccgccagagccatcgccacccaggtgggcatcaacaaggtgttcgccgaggtgctgcccagccacaaggtggccaaggtgcaggagctgcagaacaagggcaagaaggtggccatggtgggcgacggcgtgaacgacagccccgccctggcccaggccgacatgggcgtggccatcggcaccggcaccgacgtggccatcgaggccgccgacgtggtgctgatcagaaacgacctgctggacgtggtggccagcatccacctgagcaagagaaccgtgagaagaatcagaatcaacctggtgctggccctgatctacaacctggtgggcatccccatcgccgccggcgtgttcatgcccatcggcatcgtgctgcagccctggatgggcagcgccgccatggccgccagcagcgtgagcgtggtgctgagcagcctgcagctgaagtgctacaagaagcccgacctggagagatacgaggcccaggcccacggccacatgaagcccctgaccgccagccaggtgagcgtgcacatcggcatggacgacagatggagagacagccccagagccaccccctgggaccaggtgagctacgtgagccaggtgagcctgagcagcctgaccagcgacaagcccagcagacacagcgccgccgccgacgacgacggcgacaagtggagcctgctgctgaacggcagagacgaggagcagtacatctag

SEQ ID NO: 1763 - DNA, 4065 bp, Artificial Sequence
  Description of Artificial Sequence: Synthetic coding sequence
atgcccgagcaggagagacagatcaccgccagagagggcgccagcagaaagatcctgagcaagctgagcctgcccaccagagcctgggagcccgccatgaagaagagcttcgccttcgacaacgtgggctacgagggcggcctggacggcctgggccccagcagccaggtggccaccagcaccgtgagaatcctgggcatgacctgccagagctgcgtgaagagcatcgaggacagaatcagcaacctgaagggcatcatcagcatgaaggtgagcctggagcagggcagcgccaccgtgaagtacgtgcccagcgtggtgtgcctgcagcaggtgtgccaccagatcggcgacatgggcttcgaggccagcatcgccgagggcaaggccgccagctggcccagcagaagcctgcccgcccaggaggccgtggtgaagctgagagtggagggcatgacctgccagagctgcgtgagcagcatcgagggcaaggtgagaaagctgcagggcgtggtgagagtgaaggtgagcctgagcaaccaggaggccgtgatcacctaccagccctacctgatccagcccgaggacctgagagaccacgtgaacgacatgggcttcgaggccgccatcaagagcaaggtggcccccctgagcctgggccccatcgacatcgagagactgcagagcaccaaccccaagagacccctgagcagcgccaaccagaacttcaacaacagcgagaccctgggccaccagggcagccacgtggtgaccctgcagctgagaatcgacggcatgcactgcatgatcagccagctggagggcgtgcagcagatcagcgtgagcctggccgagggcaccgccaccgtgctgtacaaccccagcgtgatcagccccgaggagctgagagccgccatcgaggacatgggcttcgaggccagcgtggtgagcgagagctgcagcaccaaccccctgggcaaccacagcgccggcaacagcatggtgcagaccaccgacggcacccccaccagcgtgcaggaggtggccccccacaccggcagactgcccgccaaccacgcccccgacatcctggccaagagcccccagagcaccagagccgtggccccccagaagtgcttcctgcagatcaagggcatgacctgcgccagctgcgtgagcaacatcgagagaaacctgcagaaggaggccggcgtgctgagcgtgctggtggccctgatggccggcaaggccgagatcaagtacgaccccgaggtgatccagcccctggagatcgcccagttcatccaggacctgggcttcgaggccgccgtgatggaggactacgccggcagcgacggcaacatcgagctgaccatcaccggcatgacctgcgccagctgcgtgcacaacatcgagagcaagctgaccagaaccaacggcatcacctacgccagcgtggccctggccaccagcaaggccctggtgaagttcgaccccgagatcatcggccccagagacatcatcaagatcatcgaggagatcggcttccacgccagcctggcccagagaaaccccaacgcccaccacctggaccacaagatggagatcaagcagtggaagaagagcttcctgtgcagcctggtgttcggcatccccgtgatggccctgatgatctacatgctgatccccagcaacgagccccaccagagcatggtgctggaccacaacatcatccccggcctgagcatcctgaacctgatcttcttcatcctgtgcaccttcgtgcagctgctgggcggctggtacttctacgtgcaggcctacaagagcctgagacacagaagcgccaacatggacgtgctgatcgtgctggccaccagcatcgcctacgtgtacagcctggtgatcctggtggtggccgtggccgagaaggccgagagaagccccgtgaccttcttcgacaccccccccatgctgttcgtgttcatcgccctgggcagatggctggagcacctggccaagagcaagaccagcgaggccctggccaagctgatgagcctgcaggccaccgaggccaccgtggtgaccctgggcgaggacaacctgatcatcagagaggagcaggtgcccatggagctggtgcagagaggcgacatcgtgaaggtggtgcccggcggcaagttccccgtggacggcaaggtgctggagggcaacaccatggccgacgagagcctgatcaccggcgaggccatgcccgtgaccaagaagcccggcagcaccgtgatcgccggcagcatcaacgcccacggcagcgtgctgatcaaggccacccacgtgggcaacgacaccaccctggcccagatcgtgaagctggtggaggaggcccagatgagcaaggcccccatccagcagctggccgacagattcagcggctacttcgtgcccttcatcatcatcatgagcaccctgaccctggtggtgtggatcgtgatcggcttcatcgacttcggcgtggtgcagagatacttccccaaccccaacaagcacatcagccagaccgaggtgatcatcagattcgccttccagaccagcatcaccgtgctgtgcatcgcctgcccctgcagcctgggcctggccacccccaccgccgtgatggtgggcaccggcgtggccgcccagaacggcatcctgatcaagggcggcaagcccctggagatggcccacaagatcaagaccgtgatgttcgacaagaccggcaccatcacccacggcgtgcccagagtgatgagagtgctgctgctgggcgacgtggccaccctgcccctgagaaaggtgctggccgtggtgggcaccgccgaggccagcagcgagcaccccctgggcgtggccgtgaccaagtactgcaaggaggagctgggcaccgagaccctgggctactgcaccgacttccaggccgtgcccggctgcggcatcggctgcaaggtgagcaacgtggagggcatcctggcccacagcgagagacccctgagcgcccccgccagccacctgaacgaggccggcagcctgcccgccgagaaggacgccgtgccccagaccttcagcgtgctgatcggcaacagagagtggctgagaagaaacggcctgaccatcagcagcgacgtgagcgacgccatgaccgaccacgagatgaagggccagaccgccatcctggtggccatcgacggcgtgctgtgcggcatgatcgccatcgccgacgccgtgaagcaggaggccgccctggccgtgcacaccctgcagagcatgggcgtggacgtggtgctgatcaccggcgacaacagaaagaccgccagagccatcgccacccaggtgggcatcaacaaggtgttcgccgaggtgctgcccagccacaaggtggccaaggtgcaggagctgcagaacaagggcaagaaggtggccatggtgggcgacggcgtgaacgacagccccgccctggcccaggccgacatgggcgtggccatcggcaccggcaccgacgtggccatcgaggccgccgacgtggtgctgatcagaaacgacctgctggacgtggtggccagcatccacctgagcaagagaaccgtgagaagaatcagaatcaacctggtgctggccctgatctacaacctggtgggcatccccatcgccgccggcgtgttcatgcccatcggcatcgtgctgcagccctggatgggcagcgccgccatggccgccagcagcgtgagcgtggtgctgagcagcctgcagctgaagtgctacaagaagcccgacctggagagatacgaggcccaggcccacggccacatgaagcccctgaccgccagccaggtgagcgtgcacatcggcatggacgacagatggagagacagccccagagccaccccctgggaccaggtgagctacgtgagccaggtgagcctgagcagcctgaccagcgacaagcccagcagacacagcgccgccgccgacgacgacggcgacaagtggagcctgctgctgaacggcagagacgaggagcagtacatctag

SEQ ID NO: 1764 - DNA, 3108 bp, Artificial Sequence
  Description of Artificial Sequence: Synthetic coding sequence
atgcccgagcaggagagacagatcaccgccagagagggcgccagcagaaagatcctgagcaagctgagcctgcccaccagagcctgggagcccgccatgaagaagagcttcgccttcgacaacgtgggctacgagggcggcctggacggcctgggccccagcagccaggtggccaccagcaccgtgagaatcctgggcatgacctgccagagctgcgtgaagagcatcgaggacagaatcagcaacctgaagggcatcatcagcatgaaggtgagcctggagcagggcagcgccaccgtgaagtacgtgcccagcgtggtgtgcctgcagcaggtgtgccaccagatcggcgacatgggcttcgaggccagcatcgccgagggcaaggccgccagctggcccagcagaagcctgcccgcccaggaggccgtggtgaagctgagagtggagggcatgacctgccagagctgcgtgagcagcatcgagggcaaggtgagaaagctgcagggcgtggtgagagtgaaggtgagcctgagcaaccaggaggccgtgatcacctaccagccctacctgatccagcccgaggacctgagagaccacgtgaacgacatgggcttcgaggccgccatcaagagcaaggtggcccccctgagcctgggccccatcgacatcgagagactgcagagcaccaaccccaagagacccctgagcagcgccaaccagaacttcaacaacagcgagaccctgggccaccagggcagccacgtggtgaccctgcagctgagaatcgacggcatgcactgcaagagctgcgtgctgaacatcgaggagaacatcggccagctgctgggcgtgcagagcatccaggtgagcctggagaacaagaccgcccaggtgaagtacgaccccagctgcaccagccccgtggccctgcagagagccatcgaggccctgccccccggcaacttcaaggtgagcctgcccgacggcgccgagggcagcggcaccgaccacagaagcagcagcagccacagccccggcagcccccccagaaaccaggtgcagggcacctgcagcaccaccctgatcgccatcgccggcatgacctgcgccagctgcgtgcacagcatcgagggcatgatcagccagctggagggcgtgcagcagatcagcgtgagcctggccgagggcaccgccaccgtgctgtacaaccccagcgtgatcagccccgaggagctgagagccgccatcgaggacatgggcttcgaggccagcgtggtgagcggcgaggccatgcccgtgaccaagaagcccggcagcaccgtgatcgccggcagcatcaacgcccacggcagcgtgctgatcaaggccacccacgtgggcaacgacaccaccctggcccagatcgtgaagctggtggaggaggcccagatgagcaaggcccccatccagcagctggccgacagattcagcggctacttcgtgcccttcatcatcatcatgagcaccctgaccctggtggtgtggatcgtgatcggcttcatcgacttcggcgtggtgcagagatacttccccaaccccaacaagcacatcagccagaccgaggtgatcatcagattcgccttccagaccagcatcaccgtgctgtgcatcgcctgcccctgcagcctgggcctggccacccccaccgccgtgatggtgggcaccggcgtggccgcccagaacggcatcctgatcaagggcggcaagcccctggagatggcccacaagatcaagaccgtgatgttcgacaagaccggcaccatcacccacggcgtgcccagagtgatgagagtgctgctgctgggcgacgtggccaccctgcccctgagaaaggtgctggccgtggtgggcaccgccgaggccagcagcgagcaccccctgggcgtggccgtgaccaagtactgcaaggaggagctgggcaccgagaccctgggctactgcaccgacttccaggccgtgcccggctgcggcatcggctgcaaggtgagcaacgtggagggcatcctggcccacagcgagagacccctgagcgcccccgccagccacctgaacgaggccggcagcctgcccgccgagaaggacgccgtgccccagaccttcagcgtgctgatcggcaacagagagtggctgagaagaaacggcctgaccatcagcagcgacgtgagcgacgccatgaccgaccacgagatgaagggccagaccgccatcctggtggccatcgacggcgtgctgtgcggcatgatcgccatcgccgacgccgtgaagcaggaggccgccctggccgtgcacaccctgcagagcatgggcgtggacgtggtgctgatcaccggcgacaacagaaagaccgccagagccatcgccacccaggtgggcatcaacaaggtgttcgccgaggtgctgcccagccacaaggtggccaaggtgcaggagctgcagaacaagggcaagaaggtggccatggtgggcgacggcgtgaacgacagccccgccctggcccaggccgacatgggcgtggccatcggcaccggcaccgacgtggccatcgaggccgccgacgtggtgctgatcagaaacgacctgctggacgtggtggccagcatccacctgagcaagagaaccgtgagaagaatcagaatcaacctggtgctggccctgatctacaacctggtgggcatccccatcgccgccggcgtgttcatgcccatcggcatcgtgctgcagccctggatgggcagcgccgccatggccgccagcagcgtgagcgtggtgctgagcagcctgcagctgaagtgctacaagaagcccgacctggagagatacgaggcccaggcccacggccacatgaagcccctgaccgccagccaggtgagcgtgcacatcggcatggacgacagatggagagacagccccagagccaccccctgggaccaggtgagctacgtgagccaggtgagcctgagcagcctgaccagcgacaagcccagcagacacagcgccgccgccgacgacgacggcgacaagtggagcctgctgctgaacggcagagacgaggagcagtacatctag

SEQ ID NO: 1765 - DNA, 2031 bp, Artificial Sequence
  Description of Artificial Sequence: Synthetic coding sequence
atggacgtgctgatcgtgctggccaccagcatcgcctacgtgtacagcctggtgatcctggtggtggccgtggccgagaaggccgagagaagccccgtgaccttcttcgacaccccccccatgctgttcgtgttcatcgccctgggcagatggctggagcacctggccaagagcaagaccagcgaggccctggccaagctgatgagcctgcaggccaccgaggccaccgtggtgaccctgggcgaggacaacctgatcatcagagaggagcaggtgcccatggagctggtgcagagaggcgacatcgtgaaggtggtgcccggcggcaagttccccgtggacggcaaggtgctggagggcaacaccatggccgacgagagcctgatcaccggcgaggccatgcccgtgaccaagaagcccggcagcaccgtgatcgccggcagcatcaacgcccacggcagcgtgctgatcaaggccacccacgtgggcaacgacaccaccctggcccagatcgtgaagctggtggaggaggcccagatgagcaaggcccccatccagcagctggccgacagattcagcggctacttcgtgcccttcatcatcatcatgagcaccctgaccctggtggtgtggatcgtgatcggcttcatcgacttcggcgtggtgcagagatacttccccaaccccaacaagcacatcagccagaccgaggtgatcatcagattcgccttccagaccagcatcaccgtgctgtgcatcgcctgcccctgcagcctgggcctggccacccccaccgccgtgatggtgggcaccggcgtggccgcccagaacggcatcctgatcaagggcggcaagcccctggagatggcccacaaggagctgggcaccgagaccctgggctactgcaccgacttccaggccgtgcccggctgcggcatcggctgcaaggtgagcaacgtggagggcatcctggcccacagcgagagacccctgagcgcccccgccagccacctgaacgaggccggcagcctgcccgccgagaaggacgccgtgccccagaccttcagcgtgctgatcggcaacagagagtggctgagaagaaacggcctgaccatcagcagcgacgtgagcgacgccatgaccgaccacgagatgaagggccagaccgccatcctggtggccatcgacggcgtgctgtgcggcatgatcgccatcgccgacgccgtgaagcaggaggccgccctggccgtgcacaccctgcagagcatgggcgtggacgtggtgctgatcaccggcgacaacagaaagaccgccagagccatcgccacccaggtgggcatcaacaaggtgttcgccgaggtgctgcccagccacaaggtggccaaggtgcaggagctgcagaacaagggcaagaaggtggccatggtgggcgacggcgtgaacgacagccccgccctggcccaggccgacatgggcgtggccatcggcaccggcaccgacgtggccatcgaggccgccgacgtggtgctgatcagaaacgacctgctggacgtggtggccagcatccacctgagcaagagaaccgtgagaagaatcagaatcaacctggtgctggccctgatctacaacctggtgggcatccccatcgccgccggcgtgttcatgcccatcggcatcgtgctgcagccctggatgggcagcgccgccatggccgccagcagcgtgagcgtggtgctgagcagcctgcagctgaagtgctacaagaagcccgacctggagagatacgaggcccaggcccacggccacatgaagcccctgaccgccagccaggtgagcgtgcacatcggcatggacgacagatggagagacagccccagagccaccccctgggaccaggtgagctacgtgagccaggtgagcctgagcagcctgaccagcgacaagcccagcagacacagcgccgccgccgacgacgacggcgacaagtggagcctgctgctgaacggcagagacgaggagcagtacatctag

SEQ ID NO: 1766 - DNA, 4203 bp, Artificial Sequence
  Description of Artificial Sequence: Synthetic coding sequence
atgcccgagcaggagagacagatcaccgccagagagggcgccagcagaaagatcctgagcaagctgagcctgcccaccagagcctgggagcccgccatgaagaagagcttcgccttcgacaacgtgggctacgagggcggcctggacggcctgggccccagcagccaggtggccaccagcaccgtgagaatcctgggcatgacctgccagagctgcgtgaagagcatcgaggacagaatcagcaacctgaagggcatcatcagcatgaaggtgagcctggagcagggcagcgccaccgtgaagtacgtgcccagcgtggtgtgcctgcagcaggtgtgccaccagatcggcgacatgggcttcgaggccagcatcgccgagggcaaggccgccagctggcccagcagaagcctgcccgcccaggaggccgtggtgaagctgagagtggagggcatgacctgccagagctgcgtgagcagcatcgagggcaaggtgagaaagctgcagggcgtggtgagagtgaaggtgagcctgagcaaccaggaggccgtgatcacctaccagccctacctgatccagcccgaggacctgagagaccacgtgaacgacatgggcttcgaggccgccatcaagagcaaggtggcccccctgagcctgggccccatcgacatcgagagactgcagagcaccaaccccaagagacccctgagcagcgccaaccagaacttcaacaacagcgagaccctgggccaccagggcagccacgtggtgaccctgcagctgagaatcgacggcatgcactgcaagagctgcgtgctgaacatcgaggagaacatcggccagctgctgggcgtgcagagcatccaggtgagcctggagaacaagaccgcccaggtgaagtacgaccccagctgcaccagccccgtggccctgcagagagccatcgaggccctgccccccggcaacttcaaggtgagcctgcccgacggcgccgagggcagcggcaccgaccacagaagcagcagcagccacagccccggcagcccccccagaaaccaggtgcagggcacctgcagcaccaccctgatcgccatcgccggcatgacctgcgccagctgcgtgcacagcatcgagggcatgatcagccagctggagggcgtgcagcagatcagcgtgagcctggccgagggcaccgccaccgtgctgtacaaccccagcgtgatcagccccgaggagctgagagccgccatcgaggacatgggcttcgaggccagcgtggtgagcgagagctgcagcaccaaccccctgggcaaccacagcgccggcaacagcatggtgcagaccaccgacggcacccccaccagcgtgcaggaggtggccccccacaccggcagactgcccgccaaccacgcccccgacatcctggccaagagcccccagagcaccagagccgtggccccccagaagtgcttcctgcagatcaagggcatgacctgcgccagctgcgtgagcaacatcgagagaaacctgcagaaggaggccggcgtgctgagcgtgctggtggccctgatggccggcaaggccgagatcaagtacgaccccgaggtgatccagcccctggagatcgcccagttcatccaggacctgggcttcgaggccgccgtgatggaggactacgccggcagcgacggcaacatcgagctgaccatcaccggcatgacctgcgccagctgcgtgcacaacatcgagagcaagctgaccagaaccaacggcatcacctacgccagcgtggccctggccaccagcaaggccctggtgaagttcgaccccgagatcatcggccccagagacatcatcaagatcatcgaggagatcggcttccacgccagcctggcccagagaaaccccaacgcccaccacctggaccacaagatggagatcaagcagtggaagaagagcttcctgtgcagcctggtgttcggcatccccgtgatggccctgatgatctacatgctgatccccagcaacgagccccaccagagcatggtgctggaccacaacatcatccccggcctgagcatcctgaacctgatcttcttcatcctgtgcaccttcgtgcagctgctgggcggctggtacttctacgtgcaggcctacaagagcctgagacacagaagcgccaacatggacgtgctgatcgtgctggccaccagcatcgcctacgtgtacagcctggtgatcctggtggtggccgtggccgagaaggccgagagaagccccgtgaccttcttcgacaccccccccatgctgttcgtgttcatcgccctgggcagatggctggagcacctggccaagagcaagaccagcgaggccctggccaagctgatgagcctgcaggccaccgaggccaccgtggtgaccctgggcgaggacaacctgatcatcagagaggagcaggtgcccatggagctggtgcagagaggcgacatcgtgaaggtggtgcccggcggcaagttccccgtggacggcaaggtgctggagggcaacaccatggccgacgagagcctgatcaccggcgaggccatgcccgtgaccaagaagcccggcagcaccgtgatcgccggcagcatcaacgcccacggcagcgtgctgatcaaggccacccacgtgggcaacgacaccaccctggcccagatcgtgaagctggtggaggaggcccagatgagcaaggcccccatccagcagctggccgacagattcagcggctacttcgtgcccttcatcatcatcatgagcaccctgaccctggtggtgtggatcgtgatcggcttcatcgacttcggcgtggtgcagagatacttccccatcaagaccgtgatgttcgacaagaccggcaccatcacccacggcgtgcccagagtgatgagagtgctgctgctgggcgacgtggccaccctgcccctgagaaaggtgctggccgtggtgggcaccgccgaggccagcagcgagcaccccctgggcgtggccgtgaccaagtactgcaaggaggagctgggcaccgagaccctgggctactgcaccgacttccaggccgtgcccggctgcggcatcggctgcaaggtgagcaacgtggagggcatcctggcccacagcgagagacccctgagcgcccccgccagccacctgaacgaggccggcagcctgcccgccgagaaggacgccgtgccccagaccttcagcgtgctgatcggcaacagagagtggctgagaagaaacggcctgaccatcagcagcgacgtgagcgacgccatgaccgaccacgagatgaagggccagaccgccatcctggtggccatcgacggcgtgctgtgcggcatgatcgccatcgccgacgccgtgaagcaggaggccgccctggccgtgcacaccctgcagagcatgggcgtggacgtggtgctgatcaccggcgacaacagaaagaccgccagagccatcgccacccaggtgggcatcaacaaggtgttcgccgaggtgctgcccagccacaaggtggccaaggtgcaggagctgcagaacaagggcaagaaggtggccatggtgggcgacggcgtgaacgacagccccgccctggcccaggccgacatgggcgtggccatcggcaccggcaccgacgtggccatcgaggccgccgacgtggtgctgatcagaaacgacctgctggacgtggtggccagcatccacctgagcaagagaaccgtgagaagaatcagaatcaacctggtgctggccctgatctacaacctggtgggcatccccatcgccgccggcgtgttcatgcccatcggcatcgtgctgcagccctggatgggcagcgccgccatggccgccagcagcgtgagcgtggtgctgagcagcctgcagctgaagtgctacaagaagcccgacctggagagatacgaggcccaggcccacggccacatgaagcccctgaccgccagccaggtgagcgtgcacatcggcatggacgacagatggagagacagccccagagccaccccctgggaccaggtgagctacgtgagccaggtgagcctgagcagcctgaccagcgacaagcccagcagacacagcgccgccgccgacgacgacggcgacaagtggagcctgctgctgaacggcagagacgaggagcagtacatctag

SEQ ID NO: 1767 - DNA, 4164 bp, Artificial Sequence
  Description of Artificial Sequence: Synthetic coding sequence
atgcccgagcaggagagacagatcaccgccagagagggcgccagcagaaagatcctgagcaagctgagcctgcccaccagagcctgggagcccgccatgaagaagagcttcgccttcgacaacgtgggctacgagggcggcctggacggcctgggccccagcagccaggtggccaccagcaccgtgagaatcctgggcatgacctgccagagctgcgtgaagagcatcgaggacagaatcagcaacctgaagggcatcatcagcatgaaggtgagcctggagcagggcagcgccaccgtgaagtacgtgcccagcgtggtgtgcctgcagcaggtgtgccaccagatcggcgacatgggcttcgaggccagcatcgccgagggcaaggccgccagctggcccagcagaagcctgcccgcccaggaggccgtggtgaagctgagagtggagggcatgacctgccagagctgcgtgagcagcatcgagggcaaggtgagaaagctgcagggcgtggtgagagtgaaggtgagcctgagcaaccaggaggccgtgatcacctaccagccctacctgatccagcccgaggacctgagagaccacgtgaacgacatgggcttcgaggccgccatcaagagcaaggtggcccccctgagcctgggccccatcgacatcgagagactgcagagcaccaaccccaagagacccctgagcagcgccaaccagaacttcaacaacagcgagaccctgggccaccagggcagccacgtggtgaccctgcagctgagaatcgacggcatgcactgcaagagctgcgtgctgaacatcgaggagaacatcggccagctgctgggcgtgcagagcatccaggtgagcctggagaacaagaccgcccaggtgaagtacgaccccagctgcaccagccccgtggccctgcagagagccatcgaggccctgccccccggcaacttcaaggtgagcctgcccgacggcgccgagggcagcggcaccgaccacagaagcagcagcagccacagccccggcagcccccccagaaaccaggtgcagggcacctgcagcaccaccctgatcgccatcgccggcatgacctgcgccagctgcgtgcacagcatcgagggcatgatcagccagctggagggcgtgcagcagatcagcgtgagcctggccgagggcaccgccaccgtgctgtacaaccccagcgtgatcagccccgaggagctgagagccgccatcgaggacatgggcttcgaggccagcgtggtgagcgagagctgcagcaccaaccccctgggcaaccacagcgccggcaacagcatggtgcagaccaccgacggcacccccaccagcgtgcaggaggtggccccccacaccggcagactgcccgccaaccacgcccccgacatcctggccaagagcccccagagcaccagagccgtggccccccagaagtgcttcctgcagatcaagggcatgacctgcgccagctgcgtgagcaacatcgagagaaacctgcagaaggaggccggcgtgctgagcgtgctggtggccctgatggccggcaaggccgagatcaagtacgaccccgaggtgatccagcccctggagatcgcccagttcatccaggacctgggcttcgaggccgccgtgatggaggactacgccggcagcgacggcaacatcgagctgaccatcaccggcatgacctgcgccagctgcgtgcacaacatcgagagcaagctgaccagaaccaacggcatcacctacgccagcgtggccctggccaccagcaaggccctggtgaagttcgaccccgagatcatcggccccagagacatcatcaagatcatcgaggagatcggcttccacgccagcctggcccagagaaaccccaacgcccaccacctggaccacaagatggagatcaagcagtggaagaagagcttcctgtgcagcctggtgttcggcatccccgtgatggccctgatgatctacatgctgatccccagcaacgagccccaccagagcatggtgctggaccacaacatcatccccggcctgagcatcctgaacctgatcttcttcatcctgtgcaccttcgtgcagagcaagaccagcgaggccctggccaagctgatgagcctgcaggccaccgaggccaccgtggtgaccctgggcgaggacaacctgatcatcagagaggagcaggtgcccatggagctggtgcagagaggcgacatcgtgaaggtggtgcccggcggcaagttccccgtggacggcaaggtgctggagggcaacaccatggccgacgagagcctgatcaccggcgaggccatgcccgtgaccaagaagcccggcagcaccgtgatcgccggcagcatcaacgcccacggcagcgtgctgatcaaggccacccacgtgggcaacgacaccaccctggcccagatcgtgaagctggtggaggaggcccagatgagcaaggcccccatccagcagctggccgacagattcagcggctacttcgtgcccttcatcatcatcatgagcaccctgaccctggtggtgtggatcgtgatcggcttcatcgacttcggcgtggtgcagagatacttccccaaccccaacaagcacatcagccagaccgaggtgatcatcagattcgccttccagaccagcatcaccgtgctgtgcatcgcctgcccctgcagcctgggcctggccacccccaccgccgtgatggtgggcaccggcgtggccgcccagaacggcatcctgatcaagggcggcaagcccctggagatggcccacaagatcaagaccgtgatgttcgacaagaccggcaccatcacccacggcgtgcccagagtgatgagagtgctgctgctgggcgacgtggccaccctgcccctgagaaaggtgctggccgtggtgggcaccgccgaggccagcagcgagcaccccctgggcgtggccgtgaccaagtactgcaaggaggagctgggcaccgagaccctgggctactgcaccgacttccaggccgtgcccggctgcggcatcggctgcaaggtgagcaacgtggagggcatcctggcccacagcgagagacccctgagcgcccccgccagccacctgaacgaggccggcagcctgcccgccgagaaggacgccgtgccccagaccttcagcgtgctgatcggcaacagagagtggctgagaagaaacggcctgaccatcagcagcgacgtgagcgacgccatgaccgaccacgagatgaagggccagaccgccatcctggtggccatcgacggcgtgctgtgcggcatgatcgccatcgccgacgccgtgaagcaggaggccgccctggccgtgcacaccctgcagagcatgggcgtggacgtggtgctgatcaccggcgacaacagaaagaccgccagagccatcgccacccaggtgggcatcaacaaggtgttcgccgaggtgctgcccagccacaaggtggccaaggtgcaggagctgcagaacaagggcaagaaggtggccatggtgggcgacggcgtgaacgacagccccgccctggcccaggccgacatgggcgtggccatcggcaccggcaccgacgtggccatcgaggccgccgacgtggtgctgatcagaaacgacctgctggacgtggtggccagcatccacctgagcaagagaaccgtgagaagaatcagaatcaacctggtgctggccctgatctacaacctggtgggcatccccatcgccgccggcgtgttcatgcccatcggcatcgtgctgcagccctggatgggcagcgccgccatggccgccagcagcgtgagcgtggtgctgagcagcctgcagctgaagtgctacaagaagcccgacctggagagatacgaggcccaggcccacggccacatgaagcccctgaccgccagccaggtgagcgtgcacatcggcatggacgacagatggagagacagccccagagccaccccctgggaccaggtgagctacgtgagccaggtgagcctgagcagcctgaccagcgacaagcccagcagacacagcgccgccgccgacgacgacggcgacaagtggagcctgctgctgaacggcagagacgaggagcagtacatctag

SEQ ID NO: 1768 - DNA, 1587 bp, Artificial Sequence
  Description of Artificial Sequence: Synthetic coding sequence
atgaagaagagcttcgccttcgacaacgtgggctacgagggcggcctggacggcctgggccccagcagccaggtggccaccagcaccgtgagaatcctgggcatgacctgccagagctgcgtgaagagcatcgaggacagaatcagcaacctgaagggcatcatcagcatgaaggtgagcctggagcagggcagcgccaccgtgaagtacgtgcccagcgtggtgtgcctgcagcaggtgtgccaccagatcggcgacatgggcttcgaggccagcatcgccgagggcaaggccgccagctggcccagcagaagcctgcccgcccaggaggccgtggtgaagctgagagtggagggcatgacctgccagagctgcgtgagcagcatcgagggcaaggtgagaaagctgcagggcgtggtgagagtgaaggtgagcctgagcaaccaggaggccgtgatcacctaccagccctacctgatccagcccgaggacctgagagaccacgtgaacgacatgggcttcgaggccgccatcaagagcaaggtggcccccctgagcctgggccccatcgacatcgagagactgcagagcaccaaccccaagagacccctgagcagcgccaaccagaacttcaacaacagcgagaccctgggccaccagggcagccacgtggtgaccctgcagctgagaatcgacggcatgcactgcaagagctgcgtgctgaacatcgaggagaacatcggccagctgctgggcgtgcagagcatccaggtgagcctggagaacaagaccgcccaggtgaagtacgaccccagctgcaccagccccgtggccctgcagagagccatcgaggccctgccccccggcaacttcaaggtgagcctgcccgacggcgccgagggcagcggcaccgaccacagaagcagcagcagccacagccccggcagcccccccagaaaccaggtgcagggcacctgcagcaccaccctgatcgccatcgccggcatgacctgcgccagctgcgtgcacagcatcgagggcatgatcagccagctggagggcgtgcagcagatcagcgtgagcctggccgagggcaccgccaccgtgctgtacaaccccagcgtgatcagccccgaggagctgagagccgccatcgaggacatgggcttcgaggccagcgtggtgagcgagagctgcagcaccaaccccctgggcaaccacagcgccggcaacagcatggtgcagaccaccgacggcacccccaccagcgtgcaggaggtggccccccacaccggcagactgcccgccaaccacgcccccgacatcctggccaagagcccccagagcaccagagccgtggccccccagaagtgcttcctgcagatcaagggcatgacctgcgccagctgcgtgagcaacatcgagagaaacctgcagaaggaggccgcccccagatgggtggtgctgctgagaagcggcctgcagatcagcgagacccaggtgagccagcacggcagagcccacagacccggccacaagcactgcctgtgcctgttcagcggccaccccggcggctgctgcggctag

SEQ ID NO: 1769 - DNA, 3966 bp, Artificial Sequence
  Description of Artificial Sequence: Synthetic coding sequence
atgagcgacagcgtgatcctgagaagcatcaagaagttcggcgaggagaacgacggcttcgagagcgacaagagctacaacaacgacaagaagagcagactgcaggacgagaagaagggcgacggcgtgagagtgggcttcttccagctgttcagattcagcagcagcaccgacatctggctgatgttcgtgggcagcctgtgcgccttcctgcacggcatcgcccagcccggcgtgctgctgatcttcggcaccatgaccgacgtgttcatcgactacgacgtggagctgcaggagctgcagatccccggcaaggcctgcgtgaacaacaccatcgtgtggaccaacagcagcctgaaccagaacatgaccaacggcaccagatgcggcctgctgaacatcgagagcgagatgatcaagttcgccagctactacgccggcatcgccgtggccgtgctgatcaccggctacatccagatctgcttctgggtgatcgccgccgccagacagatccagaagatgagaaagttctacttcagaagaatcatgagaatggagatcggctggttcgactgcaacagcgtgggcgagctgaacaccagattcagcgacgacatcaacaagatcaacgacgccatcgccgaccagatggccctgttcatccagagaatgaccagcaccatctgcggcttcctgctgggcttcttcagaggctggaagctgaccctggtgatcatcagcgtgagccccctgatcggcatcggcgccgccaccatcggcctgagcgtgagcaagttcaccgactacgagctgaaggcctacgccaaggccggcgtggtggccgacgaggtgatcagcagcatgagaaccgtggccgccttcggcggcgagaagagagaggtggagagatacgagaagaacctggtgttcgcccagagatggggcatcagaaagggcatcgtgatgggcttcttcaccggcttcgtgtggtgcctgatcttcctgtgctacgccctggccttctggtacggcagcaccctggtgctggacgagggcgagtacacccccggcaccctggtgcagatcttcctgagcgtgatcgtgggcgccctgaacctgggcaacgccagcccctgcctggaggccttcgccaccggcagagccgccgccaccagcatcttcgagaccatcgacagaaagcccatcatcgactgcatgagcgaggacggctacaagctggacagaatcaagggcgagatcgagttccacaacgtgaccttccactaccccagcagacccgaggtgaagatcctgaacgacctgaacatggtgatcaagcccggcgagatgaccgccctggtgggccccagcggcgccggcaagagcaccgccctgcagctgatccagagattctacgacccctgcgagggcatggtgaccgtggacggccacgacatcagaagcctgaacatccagtggctgagagaccagatcggcatcgtggagcaggagcccgtgctgttcagcaccaccatcgccgagaacatcagatacggcagagaggacgccaccatggaggacatcgtgcaggccgccaaggaggccaacgcctacaacttcatcatggacctgccccagcagttcgacaccctggtgggcgagggcggcggccagatgagcggcggccagaagcagagagtggccatcgccagagccctgatcagaaaccccaagatcctgctgctggacatggccaccagcgccctggacaacgagagcgaggccatggtgcaggaggtgctgagcaagatccagcacggccacaccatcatcagcgtggcccacagactgagcaccgtgagagccgccgacaccatcatcggcttcgagcacggcaccgccgtggagagaggcacccacgaggagctgctggagagaaagggcgtgtacttcaccctggtgaccctgcagagccagggcaaccaggccctgaacgaggaggacatcaaggacgccaccgaggacgacatgctggccagaaccttcagcagaggcagctaccaggacagcctgagagccagcatcagacagagaagcaagagccagctgagctacctggtgcacgagccccccctggccgtggtggaccacaagagcacctacgaggaggacagaaaggacaaggacatccccgtgcaggaggaggtggagcccgcccccgtgagaagaatcctgaagttcagcgcccccgagtggccctacatgctggtgggcagcgtgggcgccgccgtgaacggcaccgtgacccccctgtacgccttcctgttcagccagatcctgggcaccttcagcatccccgacaaggaggagcagagaagccagatcaacggcgtgtgcctgctgttcgtggccatgggctgcgtgagcctgttcacccagttcctgcagggctacgccttcgccaagagcggcgagctgctgaccaagagactgagaaagttcggcttcagagccatgctgggccaggacatcgcctggttcgacgacctgagaaacagccccggcgccctgaccaccagactggccaccgacgccagccaggtgcagggcgccgccggcagccagatcggcatgatcgtgaacagcttcaccaacgtgaccgtggccatgatcatcgccttcagcttcagctggaagctgagcctggtgatcctgtgcttcttccccttcctggccctgagcggcgccacccagaccagaatgctgaccggcttcgccagcagagacaagcaggccctggagatggtgggccagatcaccaacgaggccctgagcaacatcagaaccgtggccggcatcggcaaggagagaagattcatcgaggccctggagaccgagctggagaagcccttcaagaccgccatccagaaggccaacatctacggcttctgcttcgccttcgcccagtgcatcatgttcatcgccaacagcgccagctacagatacggcggctacctgatcagcaacgagggcctgcacttcagctacgtgttcagagtgatcagcgccgtggtgctgagcgccaccgccctgggcagagccttcagctacacccccagctacgccaaggccaagatcagcgccgccagattcttccagctgctggacagacagccccccatcagcgtgtacaacaccgccggcgagaagtgggacaacttccagggcaagatcgacttcgtggactgcaagttcacctaccccagcagacccgacagccaggtgctgaacggcctgagcgtgagcatcagccccggccagaccctggccttcgtgggcagcagcggctgcggcaagagcaccagcatccagctgctggagagattctacgaccccgaccagggcaaggtgatgatcgacggccacgacagcaagaaggtgaacgtgcagttcctgagaagcaacatcggcatcgtgagccaggagcccgtgctgttcgcctgcagcatcatggacaacatcaagtacggcgacaacaccaaggagatccccatggagagagtgatcgccgccgccaagcaggcccagctgcacgacttcgtgatgagcctgcccgagaagtacgagaccaacgtgggcagccagggcagccagctgagcagaggcgagaagcagagaatcgccatcgccagagccatcgtgagagaccccaagatcctgctgctggacgaggccaccagcgccctggacaccgagagcgagaagaccgtgcaggtggccctggacaaggccagagagggcagaacctgcatcgtgatcgcccacagactgagcaccatccagaacgccgacatcatcgccgtgatggcccagggcgtggtgatcgagaagggcacccacgaggagctgatggcccagaagggcgcctactacaagctggtgaccaccggcagccccatcagctag

SEQ ID NO: 1770 - DNA, 3861 bp, Artificial Sequence
  Description of Artificial Sequence: Synthetic coding sequence
atggacctggaggccgccaagaacggcaccgcctggagacccaccagcgccgagggcgacttcgagctgggcatcagcagcaagcagaagagaaagaagaccaagaccgtgaagatgatcggcgtgctgaccctgttcagatacagcgactggcaggacaagctgttcatgagcctgggcaccatcatggccatcgcccacggcagcggcctgcccctgatgatgatcgtgttcggcgagatgaccgacaagttcgtggacaccgccggcaacttcagcttccccgtgaacttcagcctgagcctgctgaaccccggcaagatcctggaggaggagatgaccagatacgcctactactacagcggcctgggcgccggcgtgctggtggccgcctacatccaggtgagcttctggaccctggccgccggcagacagatcagaaagatcagacagaagttcttccacgccatcctgagacaggagatcggctggttcgacatcaacgacaccaccgagctgaacaccagactgaccgacgacatcagcaagatcagcgagggcatcggcgacaaggtgggcatgttcttccaggccgtggccaccttcttcgccggcttcatcgtgggcttcatcagaggctggaagctgaccctggtgatcatggccatcagccccatcctgggcctgagcgccgccgtgtgggccaagatcctgagcgccttcagcgacaaggagctggccgcctacgccaaggccggcgccgtggccgaggaggccctgggcgccatcagaaccgtgatcgccttcggcggccagaacaaggagctggagagataccagaagcacctggagaacgccaaggagatcggcatcaagaaggccatcagcgccaacatcagcatgggcatcgccttcctgctgatctacgccagctacgccctggccttctggtacggcagcaccctggtgatcagcaaggagtacaccatcggcaacgccatgaccgtgttcttcagcatcctgatcggcgccttcagcgtgggccaggccgccccctgcatcgacgccttcgccaacgccagaggcgccgcctacgtgatcttcgacatcatcgacaacaaccccaagatcgacagcttcagcgagagaggccacaagcccgacagcatcaagggcaacctggagttcaacgacgtgcacttcagctaccccagcagagccaacgtgaagatcctgaagggcctgaacctgaaggtgcagagcggccagaccgtggccctggtgggcagcagcggctgcggcaagagcaccaccgtgcagctgatccagagactgtacgaccccgacgagggcaccatcaacatcgacggccaggacatcagaaacttcaacgtgaactacctgagagagatcatcggcgtggtgagccaggagcccgtgctgttcagcaccaccatcgccgagaacatctgctacggcagaggcaacgtgaccatggacgagatcaagaaggccgtgaaggaggccaacgcctacgagttcatcatgaagctgccccagaagttcgacaccctggtgggcgagagaggcgcccagctgagcggcggccagaagcagagaatcgccatcgccagagccctggtgagaaaccccaagatcctgctgctggacgaggccaccagcgccctggacaccgagagcgaggccgaggtgcaggccgccctggacaaggccagagagggcagaaccaccatcgtgatcgcccacagactgagcaccgtgagaaacgccgacgtgatcgccggcttcgaggacggcgtgatcgtggagcagggcagccacagcgagctgatgaagaaggagggcgtgtacttcaagctggtgaacatgcagaccagcggcagccagatccagagcgaggagttcgagctgaacgacgagaaggccgccaccagaatggcccccaacggctggaagagcagactgttcagacacagcacccagaagaacctgaagaacagccagatgtgccagaagagcctggacgtggagaccgacggcctggaggccaacgtgccccccgtgagcttcctgaaggtgctgaagctgaacaagaccgagtggccctacttcgtggtgggcaccgtgtgcgccatcgccaacggcggcctgcagcccgccttcagcgtgatcttcagcgagatcatcgccatcttcggccccggcgacgacgccgtgaagcagcagaagtgcaacatcttcagcctgatcttcctgttcctgggcatcatcagcttcttcaccttcttcctgcagggcttcaccttcggcaaggccggcgagatcctgaccagaagactgagaagcatggccttcaaggccatgctgagacaggacatgagctggttcgacgaccacaagaacagcaccggcgccctgagcaccagactggccaccgacgccgcccaggtgcagggcgccaccggcaccagactggccctgatcgcccagaacatcgccaacctgggcaccggcatcatcatcagcttcatctacggctggcagctgaccctgctgctgctggccgtggtgcccatcatcgccgtgagcggcatcgtggagatgaagctgctggccggcaacgccaagagagacaagaaggagctggaggccgccggcaagatcgccaccgaggccatcgagaacatcagaaccgtggtgagcctgacccaggagagaaagttcgagagcatgtacgtggagaagctgtacggcccctacagaaacagcgtgcagaaggcccacatctacggcatcaccttcagcatcagccaggccttcatgtacttcagctacgccggctgcttcagattcggcgcctacctgatcgtgaacggccacatgagattcagagacgtgatcctggtgttcagcgccatcgtgttcggcgccgtggccctgggccacgccagcagcttcgcccccgactacgccaaggccaagctgagcgccgcccacctgttcatgctgttcgagagacagcccctgatcgacagctacagcgaggagggcctgaagcccgacaagttcgagggcaacatcaccttcaacgaggtggtgttcaactaccccaccagagccaacgtgcccgtgctgcagggcctgagcctggaggtgaagaagggccagaccctggccctggtgggcagcagcggctgcggcaagagcaccgtggtgcagctgctggagagattctacgaccccctggccggcaccgtgttcgtggacttcggcttccagctgctggacggccaggaggccaagaagctgaacgtgcagtggctgagagcccagctgggcatcgtgagccaggagcccatcctgttcgactgcagcatcgccgagaacatcgcctacggcgacaacagcagagtggtgagccaggacgagatcgtgagcgccgccaaggccgccaacatccaccccttcatcgagaccctgccccacaagtacgagaccagagtgggcgacaagggcacccagctgagcggcggccagaagcagagaatcgccatcgccagagccctgatcagacagccccagatcctgctgctggacgaggccaccagcgccctggacaccgagagcgagaaggtggtgcaggaggccctggacaaggccagagagggcagaacctgcatcgtgatcgcccacagactgagcaccatccagaacgccgacctgatcgtggtgttccagaacggcagagtgaaggagcacggcacccaccagcagctgctggcccagaagggcatctacttcagcatggtgagcgtgcaggccggcacccagaacctgtag

SEQ ID NO: 1771 - DNA, 3699 bp, Artificial Sequence
  Description of Artificial Sequence: Synthetic coding sequence
atggacctggaggccgccaagaacggcaccgcctggagacccaccagcgccgagggcgacttcgagctgggcatcagcagcaagcagaagagaaagaagaccaagaccgtgaagatgatcggcgtgctgaccctgttcagatacagcgactggcaggacaagctgttcatgagcctgggcaccatcatggccatcgcccacggcagcggcctgcccctgatgatgatcgtgttcggcgagatgaccgacaagttcgtggacaccgccggcaacttcagcttccccgtgaacttcagcctgagcctgctgaaccccggcaagatcctggaggaggagatgaccagatacgcctactactacagcggcctgggcgccggcgtgctggtggccgcctacatccaggtgagcttctggaccctggccgccggcagacagatcagaaagatcagacagaagttcttccacgccatcctgagacaggagatcggctggttcgacatcaacgacaccaccgagctgaacaccagactgaccgacgacatcagcaagatcagcgagggcatcggcgacaaggtgggcatgttcttccaggccgtggccaccttcttcgccggcttcatcgtgggcttcatcagaggctggaagctgaccctggtgatcatggccatcagccccatcctgggcctgagcgccgccgtgtgggccaagatcctgagcgccttcagcgacaaggagctggccgcctacgccaaggccggcgccgtggccgaggaggccctgggcgccatcagaaccgtgatcgccttcggcggccagaacaaggagctggagagataccagaagcacctggagaacgccaaggagatcggcatcaagaaggccatcagcgccaacatcagcatgggcatcgccttcctgctgatctacgccagctacgccctggccttctggtacggcagcaccctggtgatcagcaaggagtacaccatcggcaacgccatgaccgtgttcttcagcatcctgatcggcgccttcagcgtgggccaggccgccccctgcatcgacgccttcgccaacgccagaggcgccgcctacgtgatcttcgacatcatcgacaacaaccccaagatcgacagcttcagcgagagaggccacaagcccgacagcatcaagggcaacctggagttcaacgacgtgcacttcagctaccccagcagagccaacgtgaagatcctgaagggcctgaacctgaaggtgcagagcggccagaccgtggccctggtgggcagcagcggctgcggcaagagcaccaccgtgcagctgatccagagactgtacgaccccgacgagggcaccatcaacatcgacggccaggacatcagaaacttcaacgtgaactacctgagagagatcatcggcgtggtgagccaggagcccgtgctgttcagcaccaccatcgccgagaacatctgctacggcagaggcaacgtgaccatggacgagatcaagaaggccgtgaaggaggccaacgcctacgagttcatcatgaagctgccccagaagttcgacaccctggtgggcgagagaggcgcccagctgagcggcggccagaagcagagaatcgccatcgccagagccctggtgagaaaccccaagatcctgctgctggacgaggccaccagcgccctggacaccgagagcgaggccgaggtgcaggccgccctggacaaggccagagagggcagaaccaccatcgtgatcgcccacagactgagcaccgtgagaaacgccgacgtgatcgccggcttcgaggacggcgtgatcgtggagcagggcagccacagcgagctgatgaagaaggagggcgtgtacttcaagctggtgaacatgcagaccagcggcagccagatccagagcgaggagttcgagctgaacgacgagaaggccgccaccagaatggcccccaacggctggaagagcagactgttcagacacagcacccagaagaacctgaagaacagccagatgtgccagaagagcctggacgtggagaccgacggcctggaggccaacgtgccccccgtgagcttcctgaaggtgctgaagctgaacaagaccgagtggccctacttcgtggtgggcaccgtgtgcgccatcgccaacggcggcctgcagcccgccttcagcgtgatcttcagcgagatcatcgccatcttcggccccggcgacgacgccgtgaagcagcagaagtgcaacatcttcagcctgatcttcctgttcctgggcatcatcagcttcttcaccttcttcctgcagggcttcaccttcggcaaggccggcgagatcctgaccagaagactgagaagcatggccttcaaggccatgctgagacaggacatgagctggttcgacgaccacaagaacagcaccggcgccctgagcaccagactggccaccgacgccgcccaggtgcagggcgccaccggcaccagactggccctgatcgcccagaacatcgccaacctgggcaccggcatcatcatcagcttcatctacggctggcagctgaccctgctgctgctggccgtggtgcccatcatcgccgtgagcggcatcgtggagatgaagctgctggccggcaacgccaagagagacaagaaggagctggaggccgccggcaagatcgccaccgaggccatcgagaacatcagaaccgtggtgagcctgacccaggagagaaagttcgagagcatgtacgtggagaagctgtacggcccctacagagtgttcagcgccatcgtgttcggcgccgtggccctgggccacgccagcagcttcgcccccgactacgccaaggccaagctgagcgccgcccacctgttcatgctgttcgagagacagcccctgatcgacagctacagcgaggagggcctgaagcccgacaagttcgagggcaacatcaccttcaacgaggtggtgttcaactaccccaccagagccaacgtgcccgtgctgcagggcctgagcctggaggtgaagaagggccagaccctggccctggtgggcagcagcggctgcggcaagagcaccgtggtgcagctgctggagagattctacgaccccctggccggcaccgtgctgctggacggccaggaggccaagaagctgaacgtgcagtggctgagagcccagctgggcatcgtgagccaggagcccatcctgttcgactgcagcatcgccgagaacatcgcctacggcgacaacagcagagtggtgagccaggacgagatcgtgagcgccgccaaggccgccaacatccaccccttcatcgagaccctgccccacaagtacgagaccagagtgggcgacaagggcacccagctgagcggcggccagaagcagagaatcgccatcgccagagccctgatcagacagccccagatcctgctgctggacgaggccaccagcgccctggacaccgagagcgagaaggtggtgcaggaggccctggacaaggccagagagggcagaacctgcatcgtgatcgcccacagactgagcaccatccagaacgccgacctgatcgtggtgttccagaacggcagagtgaaggagcacggcacccaccagcagctgctggcccagaagggcatctacttcagcatggtgagcgtgcaggccggcacccagaacctgtag

SEQ ID NO: 1772 - DNA, 3840 bp, Artificial Sequence
  Description of Artificial Sequence: Synthetic coding sequence
atggacctggaggccgccaagaacggcaccgcctggagacccaccagcgccgagggcgacttcgagctgggcatcagcagcaagcagaagagaaagaagaccaagaccgtgaagatgatcggcgtgctgaccctgttcagatacagcgactggcaggacaagctgttcatgagcctgggcaccatcatggccatcgcccacggcagcggcctgcccctgatgatgatcgtgttcggcgagatgaccgacaagttcgtggacaccgccggcaacttcagcttccccgtgaacttcagcctgagcctgctgaaccccggcaagatcctggaggaggagatgaccagatacgcctactactacagcggcctgggcgccggcgtgctggtggccgcctacatccaggtgagcttctggaccctggccgccggcagacagatcagaaagatcagacagaagttcttccacgccatcctgagacaggagatcggctggttcgacatcaacgacaccaccgagctgaacaccagactgaccgacgacatcagcaagatcagcgagggcatcggcgacaaggtgggcatgttcttccaggccgtggccaccttcttcgccggcttcatcgtgggcttcatcagaggctggaagctgaccctggtgatcatggccatcagccccatcctgggcctgagcgccgccgtgtgggccaagatcctgagcgccttcagcgacaaggagctggccgcctacgccaaggccggcgccgtggccgaggaggccctgggcgccatcagaaccgtgatcgccttcggcggccagaacaaggagctggagagataccagaagcacctggagaacgccaaggagatcggcatcaagaaggccatcagcgccaacatcagcatgggcatcgccttcctgctgatctacgccagctacgccctggccttctggtacggcagcaccctggtgatcagcaaggagtacaccatcggcaacgccatgaccgtgttcttcagcatcctgatcggcgccttcagcgtgggccaggccgccccctgcatcgacgccttcgccaacgccagaggcgccgcctacgtgatcttcgacatcatcgacaacaaccccaagatcgacagcttcagcgagagaggccacaagcccgacagcatcaagggcaacctggagttcaacgacgtgcacttcagctaccccagcagagccaacgtgaagatcctgaagggcctgaacctgaaggtgcagagcggccagaccgtggccctggtgggcagcagcggctgcggcaagagcaccaccgtgcagctgatccagagactgtacgaccccgacgagggcaccatcaacatcgacggccaggacatcagaaacttcaacgtgaactacctgagagagatcatcggcgtggtgagccaggagcccgtgctgttcagcaccaccatcgccgagaacatctgctacggcagaggcaacgtgaccatggacgagatcaagaaggccgtgaaggaggccaacgcctacgagttcatcatgaagctgccccagaagttcgacaccctggtgggcgagagaggcgcccagctgagcggcggccagaagcagagaatcgccatcgccagagccctggtgagaaaccccaagatcctgctgctggacgaggccaccagcgccctggacaccgagagcgaggccgaggtgcaggccgccctggacaaggccagagagggcagaaccaccatcgtgatcgcccacagactgagcaccgtgagaaacgccgacgtgatcgccggcttcgaggacggcgtgatcgtggagcagggcagccacagcgagctgatgaagaaggagggcgtgtacttcaagctggtgaacatgcagaccagcggcagccagatccagagcgaggagttcgagctgaacgacgagaaggccgccaccagaatggcccccaacggctggaagagcagactgttcagacacagcacccagaagaacctgaagaacagccagatgtgccagaagagcctggacgtggagaccgacggcctggaggccaacgtgccccccgtgagcttcctgaaggtgctgaagctgaacaagaccgagtggccctacttcgtggtgggcaccgtgtgcgccatcgccaacggcggcctgcagcccgccttcagcgtgatcttcagcgagatcatcgccatcttcggccccggcgacgacgccgtgaagcagcagaagtgcaacatcttcagcctgatcttcctgttcctgggcatcatcagcttcttcaccttcttcctgcagggcttcaccttcggcaaggccggcgagatcctgaccagaagactgagaagcatggccttcaaggccatgctgagacaggacatgagctggttcgacgaccacaagaacagcaccggcgccctgagcaccagactggccaccgacgccgcccaggtgcagggcgccaccggcaccagactggccctgatcgcccagaacatcgccaacctgggcaccggcatcatcatcagcttcatctacggctggcagctgaccctgctgctgctggccgtggtgcccatcatcgccgtgagcggcatcgtggagatgaagctgctggccggcaacgccaagagagacaagaaggagctggaggccgccggcaagatcgccaccgaggccatcgagaacatcagaaccgtggtgagcctgacccaggagagaaagttcgagagcatgtacgtggagaagctgtacggcccctacagaaacagcgtgcagaaggcccacatctacggcatcaccttcagcatcagccaggccttcatgtacttcagctacgccggctgcttcagattcggcgcctacctgatcgtgaacggccacatgagattcagagacgtgatcctggtgttcagcgccatcgtgttcggcgccgtggccctgggccacgccagcagcttcgcccccgactacgccaaggccaagctgagcgccgcccacctgttcatgctgttcgagagacagcccctgatcgacagctacagcgaggagggcctgaagcccgacaagttcgagggcaacatcaccttcaacgaggtggtgttcaactaccccaccagagccaacgtgcccgtgctgcagggcctgagcctggaggtgaagaagggccagaccctggccctggtgggcagcagcggctgcggcaagagcaccgtggtgcagctgctggagagattctacgaccccctggccggcaccgtgctgctggacggccaggaggccaagaagctgaacgtgcagtggctgagagcccagctgggcatcgtgagccaggagcccatcctgttcgactgcagcatcgccgagaacatcgcctacggcgacaacagcagagtggtgagccaggacgagatcgtgagcgccgccaaggccgccaacatccaccccttcatcgagaccctgccccacaagtacgagaccagagtgggcgacaagggcacccagctgagcggcggccagaagcagagaatcgccatcgccagagccctgatcagacagccccagatcctgctgctggacgaggccaccagcgccctggacaccgagagcgagaaggtggtgcaggaggccctggacaaggccagagagggcagaacctgcatcgtgatcgcccacagactgagcaccatccagaacgccgacctgatcgtggtgttccagaacggcagagtgaaggagcacggcacccaccagcagctgctggcccagaagggcatctacttcagcatggtgagcgtgcaggccggcacccagaacctgtag

SEQ ID NO: 1773 - DNA, 186 bp, Artificial Sequence
  Description of Artificial Sequence: Synthetic coding sequence
atggacctggaggccgccaagaacggcaccgcctggagacccaccagcgccgagggcgacttcgagctgggcatcagcagcaagcagaagagaaagaagaccaagaccgtgaagatgatcggcgtgctgaccctgttcagatacagcgactggcaggacaagctgttcatgagcctgggcacctag

SEQ ID NO: 1774 - DNA, 3699 bp, Artificial Sequence; identical to SEQ ID NO: 1771
  Description of Artificial Sequence: Synthetic coding sequence

SEQ ID NO: 1775 - DNA, 3840 bp, Artificial Sequence; identical to SEQ ID NO: 1772
  Description of Artificial Sequence: Synthetic coding sequence

SEQ ID NO: 1776 - DNA, 1464 bp, Artificial Sequence
  Description of Artificial Sequence: Synthetic coding sequence
atgagagagaacatggccagaggcccctgcaacgcccccagatgggccagcctgatggtgctggtggccatcggcaccgccgtgaccgccgccgtgaaccccggcgtggtggtgagaatcagccagaagggcctggactacgccagccagcagggcaccgccgccctgcagaaggagctgaagagaatcaagatccccgactacagcgacagcttcaagatcaagcacctgggcaagggccactacagcttctacagcatggacatcagagagttccagctgcccagcagccagatcagcatggtgcccaacgtgggcctgaagttcagcatcagcaacgccaacatcaagatcagcggcaagtggaaggcccagaagagattcctgaagatgagcggcaacttcgacctgagcatcgagggcatgagcatcagcgccgacctgaagctgggcagcaaccccaccagcggcaagcccaccatcacctgcagcagctgcagcagccacatcaacagcgtgcacgtgcacatcagcaagagcaaggtgggctggctgatccagctgttccacaagaagatcgagagcgccctgagaaacaagatgaacagccaggtgtgcgagaaggtgaccaacagcgtgagcagcgagctgcagccctacttccagaccctgcccgtgatgaccaagatcgacagcgtggccggcatcaactacggcctggtggccccccccgccaccaccgccgagaccctggacgtgcagatgaagggcgagttctacagcgagaaccaccacaaccccccccccttcgccccccccgtgatggagttccccgccgcccacgacagaatggtgtacctgggcctgagcgactacttcttcaacaccgccggcctggtgtaccaggaggccggcgtgctgaagatgaccctgagagacgacatgatccccaaggagagcaagttcagactgaccaccaagttcttcggcaccttcctgcccgaggtggccaagaagttccccaacatgaagatccagatccacgtgagcgccagcacccccccccacctgagcgtgcagcccaccggcctgaccttctaccccgccgtggacgtgcaggccttcgccgtgctgcccaacagcagcctggccagcctgttcctgatcggcatgcacaccaccggcagcatggaggtgagcgccgagagcaacagactggtgggcgagctgaagctggacagactgctgctggagctgaagcacagcaacatcggccccttccccgtggagctgctgcaggacatcatgaactacatcgtgcccatcctggtgctgcccagagtgaacgagaagctgcagaagggcttccccctgcccacccccgccagagtgcagctgtacaacgtggtgctgcagccccaccagaacttcctgctgttcggcgccgacgtggtgtacaagtag

SEQ ID NO: 1777 - DNA, 1449 bp, Artificial Sequence
  Description of Artificial Sequence: Synthetic coding sequence
atggacgagggcatcccccacctgcaggagagacagctgctggagcacagagacttcatcggcctggactacagcagcctgtacatgtgcaagcccaagagaagcatgaagagagacgacaccaaggacacctacaagctgccccacagactgatcgagaagaagagaagagacagaatcaacgagtgcatcgcccagctgaaggacctgctgcccgagcacctgaagctgaccaccctgggccacctggagaaggccgtggtgctggagctgaccctgaagcacctgaaggccctgaccgccctgaccgagcagcagcaccagaagatcatcgccctgcagaacggcgagagaagcctgaagagccccatccagagcgacctggacgccttccacagcggcttccagacctgcgccaaggaggtgctgcagtacctgagcagattcgagagctggacccccagagagcccagatgcgtgcagctgatcaaccacctgcacgccgtggccacccagttcctgcccaccccccagctgctgacccagcaggtgcccctgagcaagggcaccggcgcccccagcgccgccggcagcgccgccgccccctgcctggagagagccggccagaagctggagcccctggcctactgcgtgcccgtgatccagagaacccagcccagcgccgagctggccgccgagaacgacaccgacaccgacagcggctacggcggcgaggccgaggccagacccgacagagagaagggcaagggcgccggcgccagcagagtgaccatcaagcaggagccccccggcgaggacagccccgcccccaagagaatgaagctggacagcagaggcggcggcagcggcggcggccccggcggcggcgccgccgccgccgccgccgccctgctgggccccgaccccgccgccgccgccgccctgctgagacccgacgccgccctgctgagcagcctggtggccttcggcggcggcggcggcgcccccttcccccagcccgccgccgccgccgcccccttctgcctgcccttctgcttcctgagccccagcgccgccgccgcctacgtgcagcccttcctggacaagagcggcctggagaagtacctgtaccccgccgccgccgccgcccccttccccctgctgtaccccggcatccccgcccccgccgccgccgccgccgccgccgccgccgccgccgccgccgccgccgccttcccctgcctgagcagcgtgctgagccccccccccgagaaggccggcgccgccgccgccaccctgctgccccacgaggtggcccccctgggcgccccccacccccagcacccccacggcagaacccacctgcccttcgccggccccagagagcccggcaaccccgagagcagcgcccaggaggaccccagccagcccggcaaggaggccccctag

SEQ ID NO: 1778 - DNA, 1113 bp, Artificial Sequence
  Description of Artificial Sequence: Synthetic coding sequence
atggacgagggcatcccccacctgcaggagagacagctgctggagcacagagacttcatcggcctggactacagcagcctgtacatgtgcaagcccaagagaagcatgaagagagacgacaccaaggacacctacaagctgccccacagactgatcgagaagaagagaagagacagaatcaacgagtgcatcgcccagctgaaggacctgctgcccgagcacctgaagctgaccaccctgggccacctggagaaggccgtggtgctggagctgaccctgaagcacctgaaggccctgaccgccctgaccgagcagcagcaccagaagatcatcgccctgcagaacggcgagagaagcctgaagagccccatccagagcgacctggacgccttccacagcggcttccagacctgcgccaaggaggtgctgcagtacctgagcagattcgagagctggacccccagagagcccagatgcgtgcagctgatcaaccacctgcacgccgtggccacccagttcctgcccaccccccagctgctgacccagcaggtgcccctgagcaagggcaccggcgcccccagcgccgccggcagcgccgccgccccctgcctggagagagccggccagaagctggagcccctggcctactgcgtgcccgtgatccagagaacccagcccagcgccgagctggccgccgagaacgacaccgacaccgacagcggctacggcggcgaggccgaggccagacccgacagagagaagggcaagggcgccggcgccagcagagtgaccatcaagcaggagccccccggcgaggacagccccccccccccccccagaagccccgcctgccccagatgctgcagacccctgcccagaagaagagcccccccccccagacccagctgcagaaccagatggagacccctgggcagaagaacccccagcaccagaaccgccgcccccacctgccccagccccggccccgccagcagaggcaccagaagagccctgctgagaaagatccccagaagccaggagagaaagctgcccgagagcctgagacccgagggcagaagattcaagcagagcgagaagctgaagtacccctag

SEQ ID NO: 1779 - DNA, 1191 bp, Artificial Sequence
  Description of Artificial Sequence: Synthetic coding sequence
atggtggccggcaccagatgcctgctggccctgctgctgccccaggtgctgctgggcggcgccgccggcctggtgcccgagctgggcagaagaaagttcgccgccgccagcagcggcagacccagcagccagcccagcgacgaggtgctgagcgagttcgagctgagactgctgagcatgttcggcctgaagcagagacccacccccagcagagacgccgtggtgcccccctacatgctggacctgtacagaagacacagcggccagcccggcagccccgcccccgaccacagactggagagagccgccagcagagccaacaccgtgagaagcttccaccacgaggagagcctggaggagctgcccgagaccagcggcaagaccaccagaagattcttcttcaacctgagcagcatccccaccgaggagttcatcaccagcgccgagctgcaggtgttcagagagcagatgcaggacgccctgggcaacaacagcagcttccaccacagaatcaacatctacgagatcatcaagcccgccaccgccaacagcaagttccccgtgaccagactgctggacaccagactggtgaaccagaacgccagcagatgggagagcttcgacgtgacccccgccgtgatgagatggaccgcccagggccacgccaaccacggcttcgtggtggaggtggcccacctggaggagaagcagggcgtgagcaagagacacgtgagaatcagcagaagcctgcaccaggacgagcacagctggagccagatcagacccctgctggtgaccttcggccacgacggcaagggccaccccctgcacaagagagagaagagacaggccaagcacaagcagagaaagagactgaagagcagctgcaagagacaccccctgtacgtggacttcagcgacgtgggctggaacgactggatcgtggccccccccggctaccacgccttctactgccacggcgagtgccccttccccctggccgaccacctgaacagcaccaaccacgccatcgtgcagaccctggtgaacagcgtgaacagcaagatccccaaggcctgctgcgtgcccaccgagctgagcgccatcagcatgctgtacctggacgagaacgagaaggtggtgctgaagaactaccaggacatggtggtggagggctgcggctgcagatag

SEQ ID NO: 1780 - DNA, 1296 bp, Artificial Sequence
  Description of Artificial Sequence: Synthetic coding sequence
atgcacgtgagaagcctgagagccgccgccccccacagcttcgtggccctgtgggcccccctgttcctgctgagaagcgccctggccgacttcagcctggacaacgaggtgcacagcagcttcatccacagaagactgagaagccaggagagaagagagatgcagagagagatcctgagcatcctgggcctgccccacagacccagaccccacctgcagggcaagcacaacagcgcccccatgttcatgctggacctgtacaacgccatggccgtggaggagggcggcggccccggcggccagggcttcagctacccctacaaggccgtgttcagcacccagggcccccccctggccagcctgcaggacagccacttcctgaccgacgccgacatggtgatgagcttcgtgaacctggtggagcacgacaaggagttcttccaccccagataccaccacagagagttcagattcgacctgagcaagatccccgagggcgaggccgtgaccgccgccgagttcagaatctacaaggactacatcagagagagattcgacaacgagaccttcagaatcagcgtgtaccaggtgctgcaggagcacctgggcagagagagcgacctgttcctgctggacagcagaaccctgtgggccagcgaggagggctggctggtgttcgacatcaccgccaccagcaaccactgggtggtgaaccccagacacaacctgggcctgcagctgagcgtggagaccctggacggccagagcatcaaccccaagctggccggcctgatcggcagacacggcccccagaacaagcagcccttcatggtggccttcttcaaggccaccgaggtgcacttcagaagcatcagaagcaccggcagcaagcagagaagccagaacagaagcaagacccccaagaaccaggaggccctgagaatggccaacgtggccgagaacagcagcagcgaccagagacaggcctgcaagaagcacgagctgtacgtgagcttcagagacctgggctggcaggactggatcatcgcccccgagggctacgccgcctactactgcgagggcgagtgcgccttccccctgaacagctacatgaacgccaccaaccacgccatcgtgcagaccctggtgcacttcatcaaccccgagaccgtgcccaagccctgctgcgcccccacccagctgaacgccatcagcgtgctgtacttcgacgacagcagcaacgtgatcctgaagaagtacagaaacatggtggtgagagcctgcggctgccactag

SEQ ID NO: 1781 - DNA, 1098 bp, Artificial Sequence
  Description of Artificial Sequence: Synthetic coding sequence
atgcacgtgagaagcctgagagccgccgccccccacagcttcgtggccctgtgggcccccctgttcctgctgagaagcgccctggccgacttcagcctggacaacgaggtgcacagcagcttcatccacagaagactgagaagccaggagagaagagagatgcagagagagatcctgagcatcctgggcctgccccacagacccagaccccacctgcagggcaagcacaacagcgcccccatgttcatgctggacctgtacaacgccatggccgtggaggagggcggcggccccggcggccagggcttcagctacccctacaaggccgtgttcagcacccagggcccccccctggccagcctgcaggacagccacttcctgaccgacgccgacatggtgatgagcttcgtgaacctggtggagcacgacaaggagttcttccaccccagataccaccacagagagttcagattcgacctgagcaagatccccgagggcgaggccgtgaccgccgccgagttcagaatctacaaggactacatcagagagagattcgacaacgagaccttcagaatcagcgtgtaccaggtgctgcaggagcacctgggcagagagagcgacctgttcctgctggacagcagaaccctgtgggccagcgaggagggctggctggtgttcgacatcaccgccaccagcaaccactgggtggtgaaccccagacacaacctgggcctgcagctgagcgtggagaccctggacgagaacagcagcagcgaccagagacaggcctgcaagaagcacgagctgtacgtgagcttcagagacctgggctggcaggactggatcatcgcccccgagggctacgccgcctactactgcgagggcgagtgcgccttccccctgaacagctacatgaacgccaccaaccacgccatcgtgcagaccctggtgcacttcatcaaccccgagaccgtgcccaagccctgctgcgcccccacccagctgaacgccatcagcgtgctgtacttcgacgacagcagcaacgtgatcctgaagaagtacagaaacatggtggtgagagcctgcggctgccactag

SEQ ID NO: 1782 - DNA, 1656 bp, Artificial Sequence
  Description of Artificial Sequence: Synthetic coding sequence
atggccggcgacctgagcgccggcttcttcatggaggagctgaacacctacagacagaagcagggcgtggtgctgaagtaccaggagctgcccaacagcggccccccccacgacagaagattcaccttccaggtgatcatcgacggcagagagttccccgagggcgagggcagaagcaagaaggaggccaagaacgccgccgccaagctggccgtggagatcctgaacaaggagaagaaggccgtgagccccctgctgctgaccaccaccaacagcagcgagggcctgagcatgggcaactacatcggcctgatcaacagaatcgcccagaagaagagactgaccgtgaactacgagcagtgcgccagcggcgtgcacggccccgagggcttccactacaagtgcaagatgggccagaaggagtacagcatcggcaccggcagcaccaagcaggaggccaagcagctggccgccaagctggcctacctgcagatcctgagcgaggagaccagcgtgaagagcgactacctgagcagcggcagcttcgccaccacctgcgagagccagagcaacagcctggtgaccagcaccctggccagcgagagcagcagcgagggcgacttcagcgccgacaccagcgagatcaacagcaacagcgacagcctgaacagcagcagcctgctgatgaacggcctgagaaacaaccagagaaaggccaagagaagcctggcccccagattcgacctgcccgacatgaaggagaccaagtacaccgtggacaagagattcggcatggacttcaaggagatcgagctgatcggcagcggcggcttcggccaggtgttcaaggccaagcacagaatcgacggcaagacctacgtgatcaagagagtgaagtacaacaacgagaaggccgagagagaggtgaaggccctggccaagctggaccacgtgaacatcgtgcactacaacggctgctgggacggcttcgactacgaccccgagaccagcgacgacagcctggagagcagcgactacgaccccgagaacagcaagaacagcagcagaagcaagaccaagtgcctgttcatccagatggagttctgcgacaagggcaccctggagcagtggatcgagaagagaagaggcgagaagctggacaaggtgctggccctggagctgttcgagcagatcaccaagggcgtggactacatccacagcaagaagctgatccacagagacctgaagcccagcaacatcttcctggtggacaccaagcaggtgaagatcggcgacttcggcctggtgaccagcctgaagaacgacggcaagagaaccagaagcaagggcaccctgagatacatgagccccgagcagatcagcagccaggactacggcaaggaggtggacctgtacgccctgggcctgatcctggccgagctgctgcacgtgtgcgacaccgccttcgagaccagcaagttcttcaccgacctgagagacggcatcatcagcgacatcttcgacaagaaggagaagaccctgctgcagaagctgctgagcaagaagcccgaggacagacccaacaccagcgagatcctgagaaccctgaccgtgtggaagaagagccccgagaagaacgagagacacacctgctag

SEQ ID NO: 1783 - DNA, 366 bp, Artificial Sequence
  Description of Artificial Sequence: Synthetic coding sequence
atgaccagaatcctgaccgccttcaaggtggtgagaaccctgaagaccggcttcggcttcaccaacgtgaccgcccaccagaagtggaagttcagcagacccggcatcagactgctgagcgtgaaggcccagaccgcccacatcgtgctggaggacggcaccaagatgaagggctacagcttcggccaccccagcagcgtggccggcgaggtggtgttcaacaccggcctgggcggctaccccgaggccatcaccgaccccgcctacaagggccagatcctgaccatggccaaccccatcatcggcaacggcggcgcccccgacaccaccgccctggacgagctgggcctgagcaagtacctgtag

SEQ ID NO: 1784 - DNA, 4521 bp, Artificial Sequence
  Description of Artificial Sequence: Synthetic coding sequence
atgccccagatcatcaagatgaccagaatcctgaccgccttcaaggtggtgagaaccctgaagaccggcttcggcttcaccaacgtgaccgcccaccagaagtggaagttcagcagacccggcatcagactgctgagcgtgaaggcccagaccgcccacatcgtgctggaggacggcaccaagatgaagggctacagcttcggccaccccagcagcgtggccggcgaggtggtgttcaacaccggcctgggcggctaccccgaggccatcaccgaccccgcctacaagggccagatcctgaccatggccaaccccatcatcggcaacggcggcgcccccgacaccaccgccctggacgagctgggcctgagcaagtacctggagagcaacggcatcaaggtgagcggcctgctggtgctggactacagcaaggactacaaccactggctggccaccaagagcctgggccagtggctgcaggaggagaaggtgcccgccatctacggcgtggacaccagaatgctgaccaagatcatcagagacaagggcaccatgctgggcaagatcgagttcgagggccagcccgtggacttcgtggaccccaacaagcagaacctgatcgccgaggtgagcaccaaggacgtgaaggtgtacggcaagggcaaccccaccaaggtggtggccgtggactgcggcatcaagaacaacgtgatcagactgctggtgaagagaggcgccgaggtgcacctggtgccctggaaccacgacttcaccaagatggagtacgacggcatcctgatcgccggcggccccggcaaccccgccctggccgagcccctgatccagaacgtgagaaagatcctggagagcgacagaaaggagcccctgttcggcatcagcaccggcaacctgatcaccggcctggccgccggcgccaagacctacaagatgagcatggccaacagaggccagaaccagcccgtgctgaacatcaccaacaagcaggccttcatcaccgcccagaaccacggctacgccctggacaacaccctgcccgccggctggaagcccctgttcgtgaacgtgaacgaccagaccaacgagggcatcatgcacgagagcaagcccttcttcgccgtgcagttccaccccgaggtgacccccggccccatcgacaccgagtacctgttcgacagcttcttcagcctgatcaagaagggcaaggccaccaccatcaccagcgtgctgcccaagcccgccctggtggccagcagagtggaggtgagcaaggtgctgatcctgggcagcggcggcctgagcatcggccaggccggcgagttcgactacagcggcagccaggccgtgaaggccatgaaggaggagaacgtgaagaccgtgctgatgaaccccaacatcgccagcgtgcagaccaacgaggtgggcctgaagcaggccgacaccgtgtacttcctgcccatcaccccccagttcgtgaccgaggtgatcaaggccgagcagcccgacggcctgatcctgggcatgggcggccagaccgccctgaactgcggcgtggagctgttcaagagaggcgtgctgaaggagtacggcgtgaaggtgctgggcaccagcgtggagagcatcatggccaccgaggacagacagctgttcagcgacaagctgaacgagatcaacgagaagatcgcccccagcttcgccgtggagagcatcgaggacgccctgaaggccgccgacaccatcggctaccccgtgatgatcagaagcgcctacgccctgggcggcctgggcagcggcatctgccccaacagagagaccctgatggacctgagcaccaaggccttcgccatgaccaaccagatcctggtggagaagagcgtgaccggctggaaggagatcgagtacgaggtggtgagagacgccgacgacaactgcgtgaccgtgtgcaacatggagaacgtggacgccatgggcgtgcacaccggcgacagcgtggtggtggcccccgcccagaccctgagcaacgccgagttccagatgctgagaagaaccagcatcaacgtggtgagacacctgggcatcgtgggcgagtgcaacatccagttcgccctgcaccccaccagcatggagtactgcatcatcgaggtgaacgccagactgagcagaagcagcgccctggccagcaaggccaccggctaccccctggccttcatcgccgccaagatcgccctgggcatccccctgcccgagatcaagaacgtggtgagcggcaagaccagcgcctgcttcgagcccagcctggactacatggtgaccaagatccccagatgggacctggacagattccacggcaccagcagcagaatcggcagcagcatgaagagcgtgggcgaggtgatggccatcggcagaaccttcgaggagagcttccagaaggccctgagaatgtgccaccccagcatcgagggcttcacccccagactgcccatgaacaaggagtggcccagcaacctggacctgagaaaggagctgagcgagcccagcagcaccagaatctacgccatcgccaaggccatcgacgacaacatgagcctggacgagatcgagaagctgacctacatcgacaagtggttcctgtacaagatgagagacatcctgaacatggagaagaccctgaagggcctgaacagcgagagcatgaccgaggagaccctgaagagagccaaggagatcggcttcagcgacaagcagatcagcaagtgcctgggcctgaccgaggcccagaccagagagctgagactgaagaagaacatccacccctgggtgaagcagatcgacaccctggccgccgagtaccccagcgtgaccaactacctgtacgtgacctacaacggccaggagcacgacgtgaacttcgacgaccacggcatgatggtgctgggctgcggcccctaccacatcggcagcagcgtggagttcgactggtgcgccgtgagcagcatcagaaccctgagacagctgggcaagaagaccgtggtggtgaactgcaaccccgagaccgtgagcaccgacttcgacgagtgcgacaagctgtacttcgaggagctgagcctggagagaatcctggacatctaccaccaggaggcctgcggcggctgcatcatcagcgtgggcggccagatccccaacaacctggccgtgcccctgtacaagaacggcgtgaagatcatgggcaccagccccctgcagatcgacagagccgaggacagaagcatcttcagcgccgtgctggacgagctgaaggtggcccaggccccctggaaggccgtgaacaccctgaacgaggccctggagttcgccaagagcgtggactacccctgcctgctgagacccagctacgtgctgagcggcagcgccatgaacgtggtgttcagcgaggacgagatgaagaagttcctggaggaggccaccagagtgagccaggagcaccccgtggtgctgaccaagttcgtggagggcgccagagaggtggagatggacgccgtgggcaaggacggcagagtgatcagccacgccatcagcgagcacgtggaggacgccggcgtgcacagcggcgacgccaccctgatgctgcccacccagaccatcagccagggcgccatcgagaaggtgaaggacgccaccagaaagatcgccaaggccttcgccatcagcggccccttcaacgtgcagttcctggtgaagggcaacgacgtgctggtgatcgagtgcaacctgagagccagcagaagcttccccttcgtgagcaagaccctgggcgtggacttcatcgacgtggccaccaaggtgatgatcggcgagaacgtggacgagaagcacctgcccaccctggaccaccccatcatccccgccgactacgtggccatcaaggcccccatgttcagctggcccagactgagagacgccgaccccatcctgagatgcgagatggccagcaccggcgaggtggcctgcttcggcgagggcatccacaccgccttcctgaaggccatgctgagcaccggcttcaagatcccccagaagggcatcctgatcggcatccagcagagcttcagacccagattcctgggcgtggccgagcagctgcacaacgagggcttcaagctgttcgccaccgaggccaccagcgactggctgaacgccaacaacgtgcccgccacccccgtggcctggcccagccaggagggccagaaccccagcctgagcagcatcagaaagctgatcagagacggcagcatcgacctggtgatcaacctgcccaacaacaacaccaagttcgtgcacgacaactacgtgatcagaagaaccgccgtggacagcggcatccccctgctgaccaacttccaggtgaccaagctgttcgccgaggccgtgcagaagagcagaaaggtggacagcaagagcctgttccactacagacagtacagcgccggcaaggccgcctag

SEQ ID NO: 1785 - DNA, 3150 bp, Artificial Sequence
  Description of Artificial Sequence: Synthetic coding sequence
atgaaggaggagaacgtgaagaccgtgctgatgaaccccaacatcgccagcgtgcagaccaacgaggtgggcctgaagcaggccgacaccgtgtacttcctgcccatcaccccccagttcgtgaccgaggtgatcaaggccgagcagcccgacggcctgatcctgggcatgggcggccagaccgccctgaactgcggcgtggagctgttcaagagaggcgtgctgaaggagtacggcgtgaaggtgctgggcaccagcgtggagagcatcatggccaccgaggacagacagctgttcagcgacaagctgaacgagatcaacgagaagatcgcccccagcttcgccgtggagagcatcgaggacgccctgaaggccgccgacaccatcggctaccccgtgatgatcagaagcgcctacgccctgggcggcctgggcagcggcatctgccccaacagagagaccctgatggacctgagcaccaaggccttcgccatgaccaaccagatcctggtggagaagagcgtgaccggctggaaggagatcgagtacgaggtggtgagagacgccgacgacaactgcgtgaccgtgtgcaacatggagaacgtggacgccatgggcgtgcacaccggcgacagcgtggtggtggcccccgcccagaccctgagcaacgccgagttccagatgctgagaagaaccagcatcaacgtggtgagacacctgggcatcgtgggcgagtgcaacatccagttcgccctgcaccccaccagcatggagtactgcatcatcgaggtgaacgccagactgagcagaagcagcgccctggccagcaaggccaccggctaccccctggccttcatcgccgccaagatcgccctgggcatccccctgcccgagatcaagaacgtggtgagcggcaagaccagcgcctgcttcgagcccagcctggactacatggtgaccaagatccccagatgggacctggacagattccacggcaccagcagcagaatcggcagcagcatgaagagcgtgggcgaggtgatggccatcggcagaaccttcgaggagagcttccagaaggccctgagaatgtgccaccccagcatcgagggcttcacccccagactgcccatgaacaaggagtggcccagcaacctggacctgagaaaggagctgagcgagcccagcagcaccagaatctacgccatcgccaaggccatcgacgacaacatgagcctggacgagatcgagaagctgacctacatcgacaagtggttcctgtacaagatgagagacatcctgaacatggagaagaccctgaagggcctgaacagcgagagcatgaccgaggagaccctgaagagagccaaggagatcggcttcagcgacaagcagatcagcaagtgcctgggcctgaccgaggcccagaccagagagctgagactgaagaagaacatccacccctgggtgaagcagatcgacaccctggccgccgagtaccccagcgtgaccaactacctgtacgtgacctacaacggccaggagcacgacgtgaacttcgacgaccacggcatgatggtgctgggctgcggcccctaccacatcggcagcagcgtggagttcgactggtgcgccgtgagcagcatcagaaccctgagacagctgggcaagaagaccgtggtggtgaactgcaaccccgagaccgtgagcaccgacttcgacgagtgcgacaagctgtacttcgaggagctgagcctggagagaatcctggacatctaccaccaggaggcctgcggcggctgcatcatcagcgtgggcggccagatccccaacaacctggccgtgcccctgtacaagaacggcgtgaagatcatgggcaccagccccctgcagatcgacagagccgaggacagaagcatcttcagcgccgtgctggacgagctgaaggtggcccaggccccctggaaggccgtgaacaccctgaacgaggccctggagttcgccaagagcgtggactacccctgcctgctgagacccagctacgtgctgagcggcagcgccatgaacgtggtgttcagcgaggacgagatgaagaagttcctggaggaggccaccagagtgagccaggagcaccccgtggtgctgaccaagttcgtggagggcgccagagaggtggagatggacgccgtgggcaaggacggcagagtgatcagccacgccatcagcgagcacgtggaggacgccggcgtgcacagcggcgacgccaccctgatgctgcccacccagaccatcagccagggcgccatcgagaaggtgaaggacgccaccagaaagatcgccaaggccttcgccatcagcggccccttcaacgtgcagttcctggtgaagggcaacgacgtgctggtgatcgagtgcaacctgagagccagcagaagcttccccttcgtgagcaagaccctgggcgtggacttcatcgacgtggccaccaaggtgatgatcggcgagaacgtggacgagaagcacctgcccaccctggaccaccccatcatccccgccgactacgtggccatcaaggcccccatgttcagctggcccagactgagagacgccgaccccatcctgagatgcgagatggccagcaccggcgaggtggcctgcttcggcgagggcatccacaccgccttcctgaaggccatgctgagcaccggcttcaagatcccccagaagggcatcctgatcggcatccagcagagcttcagacccagattcctgggcgtggccgagcagctgcacaacgagggcttcaagctgttcgccaccgaggccaccagcgactggctgaacgccaacaacgtgcccgccacccccgtggcctggcccagccaggagggccagaaccccagcctgagcagcatcagaaagctgatcagagacggcagcatcgacctggtgatcaacctgcccaacaacaacaccaagttcgtgcacgacaactacgtgatcagaagaaccgccgtggacagcggcatccccctgctgaccaacttccaggtgaccaagctgttcgccgaggccgtgcagaagagcagaaaggtggacagcaagagcctgttccactacagacagtacagcgccggcaaggccgcctag

SEQ ID NO: 1786 - DNA, 366 bp, Artificial Sequence; identical to SEQ ID NO: 1783
  Description of Artificial Sequence: Synthetic coding sequence

SEQ ID NO: 1787 - DNA, 1542 bp, Artificial Sequence
  Description of Artificial Sequence: Synthetic coding sequence
atgaccagaatcctgaccgccttcaaggtggtgagaaccctgaagaccggcttcggcttcaccaacgtgaccgcccaccagaagtggaagttcagcagacccggcatcagactgctgagcgtgaaggcccagaccgcccacatcgtgctggaggacggcaccaagatgaagggctacagcttcggccaccccagcagcgtggccggcgaggtggtgttcaacaccggcctgggcggctaccccgaggccatcaccgaccccgcctacaagggccagatcctgaccatggccaaccccatcatcggcaacggcggcgcccccgacaccaccgccctggacgagctgggcctgagcaagtacctggagagcaacggcatcaaggtgagcggcctgctggtgctggactacagcaaggactacaaccactggctggccaccaagagcctgggccagtggctgcaggaggagaaggtgcccgccatctacggcgtggacaccagaatgctgaccaagatcatcagagacaagggcaccatgctgggcaagatcgagttcgagggccagcccgtggacttcgtggaccccaacaagcagaacctgatcgccgaggtgagcaccaaggacgtgaaggtgtacggcaagggcaaccccaccaaggtggtggccgtggactgcggcatcaagaacaacgtgatcagactgctggtgaagagaggcgccgaggtgcacctggtgccctggaaccacgacttcaccaagatggagtacgacggcatcctgatcgccggcggccccggcaaccccgccctggccgagcccctgatccagaacgtgagaaagatcctggagagcgacagaaaggagcccctgttcggcatcagcaccggcaacctgatcaccggcctggccgccggcgccaagacctacaagatgagcatggccaacagaggccagaaccagcccgtgctgaacatcaccaacaagcaggccttcatcaccgcccagaaccacggctacgccctggacaacaccctgcccgccggctggaagcccctgttcgtgaacgtgaacgaccagaccaacgagggcatcatgcacgagagcaagcccttcttcgccgtgcagttccaccccgaggtgacccccggccccatcgacaccgagtacctgttcgacagcttcttcagcctgatcaagaagggcaaggccaccaccatcaccagcgtgctgcccaagcccgccctggtggccagcagagtggaggtgagcaaggtgctgatcctgggcagcggcggcctgagcatcggccaggccggcgagttcgactacagcggcagccaggccgtgaaggccatgaaggaggagaacgtgaagaccgtgctgatgaaccccaacatcgccagcgtgcagaccaacgaggtgggcctgaagcaggccgacaccgtgtacttcctgcccatcaccccccagttcgtgaccgaggtgatcaaggccgagcagcccgacggcctgatcctgggcatgggcgccagacagctgtag

SEQ ID NO: 1788 - DNA, 4527 bp, Artificial Sequence
  Description of Artificial Sequence: Synthetic coding sequence
agacccagaccccagatcatcaagatgaccagaatcctgaccgccttcaaggtggtgagaaccctgaagaccggcttcggcttcaccaacgtgaccgcccaccagaagtggaagttcagcagacccggcatcagactgctgagcgtgaaggcccagaccgcccacatcgtgctggaggacggcaccaagatgaagggctacagcttcggccaccccagcagcgtggccggcgaggtggtgttcaacaccggcctgggcggctaccccgaggccatcaccgaccccgcctacaagggccagatcctgaccatggccaaccccatcatcggcaacggcggcgcccccgacaccaccgccctggacgagctgggcctgagcaagtacctggagagcaacggcatcaaggtgagcggcctgctggtgctggactacagcaaggactacaaccactggctggccaccaagagcctgggccagtggctgcaggaggagaaggtgcccgccatctacggcgtggacaccagaatgctgaccaagatcatcagagacaagggcaccatgctgggcaagatcgagttcgagggccagcccgtggacttcgtggaccccaacaagcagaacctgatcgccgaggtgagcaccaaggacgtgaaggtgtacggcaagggcaaccccaccaaggtggtggccgtggactgcggcatcaagaacaacgtgatcagactgctggtgaagagaggcgccgaggtgcacctggtgccctggaaccacgacttcaccaagatggagtacgacggcatcctgatcgccggcggccccggcaaccccgccctggccgagcccctgatccagaacgtgagaaagatcctggagagcgacagaaaggagcccctgttcggcatcagcaccggcaacctgatcaccggcctggccgccggcgccaagacctacaagatgagcatggccaacagaggccagaaccagcccgtgctgaacatcaccaacaagcaggccttcatcaccgcccagaaccacggctacgccctggacaacaccctgcccgccggctggaagcccctgttcgtgaacgtgaacgaccagaccaacgagggcatcatgcacgagagcaagcccttcttcgccgtgcagttccaccccgaggtgacccccggccccatcgacaccgagtacctgttcgacagcttcttcagcctgatcaagaagggcaaggccaccaccatcaccagcgtgctgcccaagcccgccctggtggccagcagagtggaggtgagcaaggtgctgatcctgggcagcggcggcctgagcatcggccaggccggcgagttcgactacagcggcagccaggccgtgaaggccatgaaggaggagaacgtgaagaccgtgctgatgaaccccaacatcgccagcgtgcagaccaacgaggtgggcctgaagcaggccgacaccgtgtacttcctgcccatcaccccccagttcgtgaccgaggtgatcaaggccgagcagcccgacggcctgatcctgggcatgggcggccagaccgccctgaactgcggcgtggagctgttcaagagaggcgtgctgaaggagtacggcgtgaaggtgctgggcaccagcgtggagagcatcatggccaccgaggacagacagctgttcagcgacaagctgaacgagatcaacgagaagatcgcccccagcttcgccgtggagagcatcgaggacgccctgaaggccgccgacaccatcggctaccccgtgatgatcagaagcgcctacgccctgggcggcctgggcagcggcatctgccccaacagagagaccctgatggacctgagcaccaaggccttcgccatgaccaaccagatcctggtggagaagagcgtgaccggctggaaggagatcgagtacgaggtggtgagagacgccgacgacaactgcgtgaccgtgtgcaacatggagaacgtggacgccatgggcgtgcacaccggcgacagcgtggtggtggcccccgcccagaccctgagcaacgccgagttccagatgctgagaagaaccagcatcaacgtggtgagacacctgggcatcgtgggcgagtgcaacatccagttcgccctgcaccccaccagcatggagtactgcatcatcgaggtgaacgccagactgagcagaagcagcgccctggccagcaaggccaccggctaccccctggccttcatcgccgccaagatcgccctgggcatccccctgcccgagatcaagaacgtggtgagcggcaagaccagcgcctgcttcgagcccagcctggactacatggtgaccaagatccccagatgggacctggacagattccacggcaccagcagcagaatcggcagcagcatgaagagcgtgggcgaggtgatggccatcggcagaaccttcgaggagagcttccagaaggccctgagaatgtgccaccccagcatcgagggcttcacccccagactgcccatgaacaaggagtggcccagcaacctggacctgagaaaggagctgagcgagcccagcagcaccagaatctacgccatcgccaaggccatcgacgacaacatgagcctggacgagatcgagaagctgacctacatcgacaagtggttcctgtacaagatgagagacatcctgaacatggagaagaccctgaagggcctgaacagcgagagcatgaccgaggagaccctgaagagagccaaggagatcggcttcagcgacaagcagatcagcaagtgcctgggcctgaccgaggcccagaccagagagctgagactgaagaagaacatccacccctgggtgaagcagatcgacaccctggccgccgagtaccccagcgtgaccaactacctgtacgtgacctacaacggccaggagcacgacgtgaacttcgacgaccacggcatgatggtgctgggctgcggcccctaccacatcggcagcagcgtggagttcgactggtgcgccgtgagcagcatcagaaccctgagacagctgggcaagaagaccgtggtggtgaactgcaaccccgagaccgtgagcaccgacttcgacgagtgcgacaagctgtacttcgaggagctgagcctggagagaatcctggacatctaccaccaggaggcctgcggcggctgcatcatcagcgtgggcggccagatccccaacaacctggccgtgcccctgtacaagaacggcgtgaagatcatgggcaccagccccctgcagatcgacagagccgaggacagaagcatcttcagcgccgtgctggacgagctgaaggtggcccaggccccctggaaggccgtgaacaccctgaacgaggccctggagttcgccaagagcgtggactacccctgcctgctgagacccagctacgtgctgagcggcagcgccatgaacgtggtgttcagcgaggacgagatgaagaagttcctggaggaggccaccagagtgagccaggagcaccccgtggtgctgaccaagttcgtggagggcgccagagaggtggagatggacgccgtgggcaaggacggcagagtgatcagccacgccatcagcgagcacgtggaggacgccggcgtgcacagcggcgacgccaccctgatgctgcccacccagaccatcagccagggcgccatcgagaaggtgaaggacgccaccagaaagatcgccaaggccttcgccatcagcggccccttcaacgtgcagttcctggtgaagggcaacgacgtgctggtgatcgagtgcaacctgagagccagcagaagcttccccttcgtgagcaagaccctgggcgtggacttcatcgacgtggccaccaaggtgatgatcggcgagaacgtggacgagaagcacctgcccaccctggaccaccccatcatccccgccgactacgtggccatcaaggcccccatgttcagctggcccagactgagagacgccgaccccatcctgagatgcgagatggccagcaccggcgaggtggcctgcttcggcgagggcatccacaccgccttcctgaaggccatgctgagcaccggcttcaagatcccccagaagggcatcctgatcggcatccagcagagcttcagacccagattcctgggcgtggccgagcagctgcacaacgagggcttcaagctgttcgccaccgaggccaccagcgactggctgaacgccaacaacgtgcccgccacccccgtggcctggcccagccaggagggccagaaccccagcctgagcagcatcagaaagctgatcagagacggcagcatcgacctggtgatcaacctgcccaacaacaacaccaagttcgtgcacgacaactacgtgatcagaagaaccgccgtggacagcggcatccccctgctgaccaacttccaggtgaccaagctgttcgccgaggccgtgcagaagagcagaaaggtggacagcaagagcctgttccactacagacagtacagcgccggcaaggccgcctag

SEQ ID NO: 1789 - DNA, 213 bp, Artificial Sequence
  Description of Artificial Sequence: Synthetic coding sequence
atgaccagaatcctgaccgccttcaaggtggtgagaaccctgaagaccggcttcggcttcaccaacgtgaccgcccaccagaagtggaagttcagcagacccggcatcagactgctgagcgtgaaggcccagaccgcccacatcgtgctggaggacagagacgccgacacccccgcccccctgctgaaccagcccgagccccacgtgatctag

SEQ ID NO: 1790 - DNA, 606 bp, Artificial Sequence
  Description of Artificial Sequence: Synthetic coding sequence
atgagcagaagagagggcagcctggaggacccccagaccgacagcagcgtgagcctgctgccccacctggaggccaagatcagacagacccacagcctggcccacctgctgaccaagtacgccgagcagctgctgcaggagtacgtgcagctgcagggcgaccccttcggcctgcccagcttcagcccccccagactgcccgtggccggcctgagcgcccccgcccccagccacgccggcctgcccgtgcacgagagactgagactggacgccgccgccctggccgccctgccccccctgctggacgccgtgtgcagaagacaggccgagctgaaccccagagcccccagactgctgagaagactggaggacgccgccagacaggccagagccctgggcgccgccgtggaggccctgctggccgccctgggcgccgccaacagaggccccagagccgagccccccgccgccaccgccagcgccgccagcgccaccggcgtgttccccgccaaggtgctgggcctgagagtgtgcggcctgtacagagagtggctgagcagaaccgagggcgacctgggccagctgctgcccggcggcagcgcctag

SEQ ID NO: 1791 - DNA, 603 bp, Artificial Sequence
  Description of Artificial Sequence: Synthetic coding sequence
atgagcagaagagagggcagcctggacccccagaccgacagcagcgtgagcctgctgccccacctggaggccaagatcagacagacccacagcctggcccacctgctgaccaagtacgccgagcagctgctgcaggagtacgtgcagctgcagggcgaccccttcggcctgcccagcttcagcccccccagactgcccgtggccggcctgagcgcccccgcccccagccacgccggcctgcccgtgcacgagagactgagactggacgccgccgccctggccgccctgccccccctgctggacgccgtgtgcagaagacaggccgagctgaaccccagagcccccagactgctgagaagactggaggacgccgccagacaggccagagccctgggcgccgccgtggaggccctgctggccgccctgggcgccgccaacagaggccccagagccgagccccccgccgccaccgccagcgccgccagcgccaccggcgtgttccccgccaaggtgctgggcctgagagtgtgcggcctgtacagagagtggctgagcagaaccgagggcgacctgggccagctgctgcccggcggcagcgcctag

SEQ ID NO: 1792 - DNA, 513 bp, Artificial Sequence
  Description of Artificial Sequence: Synthetic coding sequence
atgaagacccagagagacggccacagcctgggcagatggagcctggtgctgctgctgctgggcctggtgatgcccctggccatcatcgcccaggtgctgagctacaaggaggccgtgctgagagccatcgacggcatcaaccagagaagcagcgacgccaacctgtacagactgctggacctggaccccagacccaccatggacggcgaccccgacacccccaagcccgtgagcttcaccgtgaaggagaccgtgtgccccagaaccacccagcagagccccgaggactgcgacttcaagaaggacggcctggtgaagagatgcatgggcaccgtgaccctgaaccaggccagaggcagcttcgacatcagctgcgacaaggacaacaagagattcgccctgctgggcgacttcttcagaaagagcaaggagaagatcggcaaggagttcaagagaatcgtgcagagaatcaaggacttcctgagaaacctggtgcccagaaccgagagctag

SEQ ID NO: 1793 - DNA, 1692 bp, Artificial Sequence
  Description of Artificial Sequence: Synthetic coding sequence
gcctgctgctgcggcggcggctgcacctgctgcggctgcacctgcaccaccggctgctgcaccacctgcacctgctgcgcctgcgcctgcaccaccggcaccaccaccggcgccggcgcctgctgcaccggcggctgcgccgccggcggcaccggctgcggcggcgccggctgctgctgcacctgctgcgccggcgccgccggcaccggctgcggcggcacctgcgccgccggctgcggcggctgcgccggctgcggcggcgccggcgcctgcggcggctgcggcgccggctgctgcgccggcggcgccgcctgctgcacctgctgctgctgctgctgcggctgcggcacctgctgctgctgcgccggctgcaccacctgctgctgcgccggctgcggcaccggcggctgcggcggctgcggcggcgccgcctgctgctgctgctgcggcggcgccggcgccgccgccggcgccgccaccgccgccgccggcgcctgcaccggcggcgccaccgcctgcgccggcggcacctgctgcgccaccaccgcctgcggcacctgcgccaccacctgcaccggctgcgccggcggctgctgcgccgccaccaccaccgccaccggcgccggcggcgccgccacctgctgcgccgccggcgccaccggcgccgccaccaccaccggcggcgccggctgcgccggcggcgccggcgccggcggctgctgcggcaccaccaccggcacctgcaccggctgcgccggcaccggctgctgctgctgcgccggcggctgcaccggctgcacctgctgctgcgccggctgcggctgcaccacctgctgctgcgccgcctgcgccggcgccggcggcgcctgctgcgccacctgcaccggcgccaccggcgccaccacctgcgccaccgccggcggctgcgcctgcgccgccgcctgcgccaccggcgccgccgccaccggcgcctgcaccaccaccggcgccgccggcaccaccacctgctgcaccacctgcgccgccaccgccgccgccgccgcctgcgccggcgcctgcgccgccaccgccaccggcaccaccgccacctgcgccggcgccacctgcgccgccgcctgcacctgctgcggcgcctgctgctgctgcgccgcctgcggcgccggcgccaccacctgctgcaccggcgccgccggcgccgcctgcaccggctgcggcgccggcggcgccggcggcaccggcggcggctgctgcacctgcaccacctgcgccggctgcggcgccggctgcaccggcggcgcctgcaccggctgcacctgctgctgcaccggcggcgccggctgcgcctgcggcgccggcaccacctgcgccggcggcgccgccggcggctgcacctgcgccggcggcgccgccggcgccggcggcgccggcgccggctgcgccggctgcgccgccggctgcggcggcgccgccaccgccacctgcacctgcggcgccaccggctgcgccaccgccgccaccggctgcgccggcaccaccggcggcaccggcggcggcggctgctgcgccaccggcgcctgcggcggcggcggctgctgctgcggcggcgccgcctgcacctgcgcctgctgcgccggctgcaccaccgccggctgcgccggctgcggctgcacctgcggcggctgcaccggctag

SEQ ID NO: 1794 - DNA, 555 bp, Artificial Sequence
  Description of Artificial Sequence: Synthetic coding sequence
atggccgaccacctgatgctggccgagggctacagactggtgcagagaccccccagcgccgccgccgcccacggcccccacgccctgagaaccctgcccccctacgccggccccggcctggacagcggcctgagacccagaggcgcccccctgggcccccccccccccagacagcccggcgccctggcctacggcgccttcggcccccccagcagcttccagcccttccccgccgtgcccccccccgccgccggcatcgcccacctgcagcccgtggccaccccctaccccggcagagccgccgccccccccaacgcccccggcggcccccccggcccccagcccgcccccagcgccgccgccccccccccccccgcccacgccctgggcggcatggacgccgagctgatcgacgaggaggccctgaccagcctggagctggagctgggcctgcacagagtgagagagctgcccgagctgttcctgggccagagcgagttcgactgcttcagcgacctgggcagcgccccccccgccggcagcgtgagctgctag

SEQ ID NO: 1795 - DNA, 3198 bp, Artificial Sequence
  Description of Artificial Sequence: Synthetic coding sequence
atgaagatcctgatcctgggcatcttcctgttcctgtgcagcacccccgcctgggccaaggagaagcactactacatcggcatcatcgagaccacctgggactacgccagcgaccacggcgagaagaagctgatcagcgtggacaccgagcacagcaacatctacctgcagaacggccccgacagaatcggcagactgtacaagaaggccctgtacctgcagtacaccgacgagaccttcagaaccaccatcgagaagcccgtgtggctgggcttcctgggccccatcatcaaggccgagaccggcgacaaggtgtacgtgcacctgaagaacctggccagcagaccctacaccttccacagccacggcatcacctactacaaggagcacgagggcgccatctaccccgacaacaccaccgacttccagagagccgacgacaaggtgtaccccggcgagcagtacacctacatgctgctggccaccgaggagcagagccccggcgagggcgacggcaactgcgtgaccagaatctaccacagccacatcgacgcccccaaggacatcgccagcggcctgatcggccccctgatcatctgcaagaaggacagcctggacaaggagaaggagaagcacatcgacagagagttcgtggtgatgttcagcgtggtggacgagaacttcagctggtacctggaggacaacatcaagacctactgcagcgagcccgagaaggtggacaaggacaacgaggacttccaggagagcaacagaatgtacagcgtgaacggctacaccttcggcagcctgcccggcctgagcatgtgcgccgaggacagagtgaagtggtacctgttcggcatgggcaacgaggtggacgtgcacgccgccttcttccacggccaggccctgaccaacaagaactacagaatcgacaccatcaacctgttccccgccaccctgttcgacgcctacatggtggcccagaaccccggcgagtggatgctgagctgccagaacctgaaccacctgaaggccggcctgcaggccttcttccaggtgcaggagtgcaacaagagcagcagcaaggacaacatcagaggcaagcacgtgagacactactacatcgccgccgaggagatcatctggaactacgcccccagcggcatcgacatcttcaccaaggagaacctgaccgcccccggcagcgacagcgccgtgttcttcgagcagggcaccaccagaatcggcggcagctacaagaagctggtgtacagagagtacaccgacgccagcttcaccaacagaaaggagagaggccccgaggaggagcacctgggcatcctgggccccgtgatctgggccgaggtgggcgacaccatcagagtgaccttccacaacaagggcgcctaccccctgagcatcgagcccatcggcgtgagattcaacaagaacaacgagggcacctactacagccccaactacaacccccagagcagaagcgtgccccccagcgccagccacgtggcccccaccgagaccttcacctacgagtggaccgtgcccaaggaggtgggccccaccaacgccgaccccgtgtgcctggccaagatgtactacagcgccgtggagcccaccaaggacatcttcaccggcctgatcggccccatgaagatctgcaagaagggcagcctgcacgccaacggcagacagaaggacgtggacaaggagttctacctgttccccaccgtgttcgacgagaacgagagcctgctgctggaggacaacatcagaatgttcaccaccgcccccgaccaggtggacaaggaggacgaggacttccaggagagcaacaagatgcacagcatgaacggcttcatgtacggcaaccagcccggcctgaccatgtgcaagggcgacagcgtggtgtggtacctgttcagcgccggcaacgaggccgacgtgcacggcatctacttcagcggcaacacctacctgtggagaggcgagagaagagacaccgccaacctgttcccccagaccagcctgaccctgcacatgtggcccgacaccgagggcaccttcaacgtggagtgcctgaccaccgaccactacaccggcggcatgaagcagaagtacaccgtgaaccagtgcagaagacagagcgaggacagcaccttctacctgggcgagagaacctactacatcgccgccgtggaggtggagtgggactacagcccccagagagagtgggagaaggagctgcaccacctgcaggagcagaacgtgagcaacgccttcctggacaagggcgagttctacatcggcagcaagtacaagaaggtggtgtacagacagtacaccgacagcaccttcagagtgcccgtggagagaaaggccgaggaggagcacctgggcatcctgggcccccagctgcacgccgacgtgggcgacaaggtgaagatcatcttcaagaacatggccaccagaccctacagcatccacgcccacggcgtgcagaccgagagcagcaccgtgacccccaccctgcccggcgagaccctgacctacgtgtggaagatccccgagagaagcggcgccggcaccgaggacagcgcctgcatcccctgggcctactacagcaccgtggaccaggtgaaggacctgtacagcggcctgatcggccccctgatcgtgtgcagaagaccctacctgaaggtgttcaaccccagaagaaagctggagttcgccctgctgttcctggtgttcgacgagaacgagagctggtacctggacgacaacatcaagacctacagcgaccaccccgagaaggtgaacaaggacgacgaggagttcatcgagagcaacaagatgcacgccatcaacggcagaatgttcggcaacctgcagggcctgaccatgcacgtgggcgacgaggtgaactggtacctgatgggcatgggcaacgagatcgacctgcacaccgtgcacttccacggccacagcttccagtacaagcacagaggcgtgtacagcagcgacgtgttcgacatcttccccggcacctaccagaccctggagatgttccccagaacccccggcatctggctgctgcactgccacgtgaccgaccacatccacgccggcatggagaccacctacaccgtgctgcagaacgaggacaccaagagcggctag

SEQ ID NO: 1796 - DNA, 603 bp, Artificial Sequence
  Description of Artificial Sequence: Synthetic coding sequence
atggccttcaccgagcacagccccctgaccccccacagaagagacctgtgcagcagaagcatctggctggccagaaagatcagaagcgacctgaccgccctgaccgagagctacgtgaagcaccagggcctgaacaagaacatcaacctggacagcgccgacggcatgcccgtggccagcaccgaccagtggagcgagctgaccgaggccgagagactgcaggagaacctgcaggcctacagaaccttccacgtgctgctggccagactgctggaggaccagcaggtgcacttcacccccaccgagggcgacttccaccaggccatccacaccctgctgctgcaggtggccgccttcgcctaccagatcgaggagctgatgatcctgctggagtacaagatccccagaaacgaggccgacggcatgcccatcaacgtgggcgacggcggcctgttcgagaagaagctgtggggcctgaaggtgctgcaggagctgagccagtggaccgtgagaagcatccacgacctgagattcatcagcagccaccagaccggcatccccgccagaggcagccactacatcgccaacaacaagaagatgtag

SEQ ID NO: 1797 - DNA, 1869 bp, Artificial Sequence
  Description of Artificial Sequence: Synthetic coding sequence
atggcccacgtgagaggcctgcagctgcccggctgcctggccctggccgccctgtgcagcctggtgcacagccagcacgtgttcctggccccccagcaggccagaagcctgctgcagagagtgagaagagccaacaccttcctggaggaggtgagaaagggcaacctggagagagagtgcgtggaggagacctgcagctacgaggaggccttcgaggccctggagagcagcaccgccaccgacgtgttctgggccaagtacaccgcctgcgagaccgccagaacccccagagacaagctggccgcctgcctggagggcaactgcgccgagggcctgggcaccaactacagaggccacgtgaacatcaccagaagcggcatcgagtgccagctgtggagaagcagatacccccacaagcccgagatcaacagcaccacccaccccggcgccgacctgcaggagaacttctgcagaaaccccgacagcagcaccaccggcccctggtgctacaccaccgaccccaccgtgagaagacaggagtgcagcatccccgtgtgcggccaggaccaggtgaccgtggccatgacccccagaagcgagggcagcagcgtgaacctgagcccccccctggagcagtgcgtgcccgacagaggccagcagtaccagggcagactggccgtgaccacccacggcctgccctgcctggcctgggccagcgcccaggccaaggccctgagcaagcaccaggacttcaacagcgccgtgcagctggtggagaacttctgcagaaaccccgacggcgacgaggagggcgtgtggtgctacgtggccggcaagcccggcgacttcggctactgcgacctgaactactgcgaggaggccgtggaggaggagaccggcgacggcctggacgaggacagcgacagagccatcgagggcagaaccgccaccagcgagtaccagaccttcttcaaccccagaaccttcggcagcggcgaggccgactgcggcctgagacccctgttcgagaagaagagcctggaggacaagaccgagagagagctgctggagagctacatcgacggcagaatcgtggagggcagcgacgccgagatcggcatgagcccctggcaggtgatgctgttcagaaagagcccccaggagctgctgtgcggcgccagcctgatcagcgacagatgggtgctgaccgccgcccactgcctgctgtaccccccctgggacaagaacttcaccgagaacgacctgctggtgagaatcggcaagcacagcagaaccagatacgagagaaacatcgagaagatcagcatgctggagaagatctacatccaccccagatacaactggagagagaacctggacagagacatcgccctgatgaagctgaagaagcccgtggccttcagcgactacatccaccccgtgtgcctgcccgacagagagaccgccgccagcctgctgcaggccggctacaagggcagagtgaccggctggggcaacctgaaggagacctggaccgccaacgtgggcaagggccagcccagcgtgctgcaggtggtgaacctgcccatcgtggagagacccgtgtgcaaggacagcaccagaatcagaatcaccgacaacatgttctgcgccggctacaagcccgacgagggcaagagaggcgacgcctgcgagggcgacagcggcggccccttcgtgatgaagagccccttcaacaacagatggtaccagatgggcatcgtgagctggggcgagggctgcgacagagacggcaagtacggcttctacacccacgtgttcagactgaagaagtggatccagaaggtgatcgaccagttcggcgagtag

SEQ ID NO: 1798 - DNA, 195 bp, Artificial Sequence
  Description of Artificial Sequence: Synthetic coding sequence
ctgcagggcgagttcctgccccagcccagacagcagcaccacggcaccctggtgctgcactacagaccccacagagaggaggccggcatgcagcacccctgcctgtggcccggcagcagccactgcagcgacgacagcaccctgagaagactgcagtgcgagagcgtgaccagcatcggcgccgtgtgcccctag

SEQ ID NO: 1799 - DNA, 1752 bp, Artificial Sequence
  Description of Artificial Sequence: Synthetic coding sequence
atggcccacgtgagaggcctgcagctgcccggctgcctggccctggccgccctgtgcagcctggtgcacagccagcacgtgttcctggccccccagcaggccagaagcctgctgcagagagtgagaagagccaacaccttcctggaggaggtgagaaagggcaacctggagagagagtgcgtggaggagacctgcagctacgaggaggccttcgaggccctggagagcagcaccgccaccgacgtgttctgggccaagtacaccgcctgcgagaccgccagaacccccagagacaagctggccgcctgcctggagggcaactgcgccgagggcctgggcaccaactacagaggccacgtgaacatcaccagaagcggcatcgagtgccagctgtggagaagcagatacccccacaagcccgagatcaacagcaccacccaccccggcgccgacctgcaggagaacttctgcagaaaccccgacagcagcaccaccggcccctggtgctacaccaccgaccccaccgtgagaagacaggagtgcagcatccccgtgtgcggccaggaccaggtgaccgtggccatgacccccagaagcgagggcagcagcgtgaacctgagcccccccctggagcagtgcgtgcccgacagaggccagcagtaccagggcagactggccgtgaccacccacggcctgccctgcctggcctgggccagcgcccaggccaaggccctgagcaagcaccaggacttcaacagcgccgtgcagctggtggagaacttctgcagaaaccccgacggcgacgaggagggcgtgtggtgctacgtggccggcaagcccggcgacttcggctactgcgacctgaactactgcgaggaggccgtggaggaggagaccggcgacggcctggacgaggacagcgacagagccatcgagggcagaaccgccaccagcgagtaccagaccttcttcaaccccagaaccttcggcagcggcgaggccgactgcggcctgagacccctgttcgagaagaagagcctggaggacaagaccgagagagagctgctggagagctacatcgacggcagaatcgtggagggcagcgacgccgagatcggcatgagcccctggcaggtgatgctgttcagaaagagcccccaggagctgctgtgcggcgccagcctgatcagcgacagatgggtgctgaccgccgcccactgcctgctgtaccccccctgggacaagaacttcaccgagaacgacctgctggtgagaatcggcaagcacagcagaaccagatacgagagaaacatcgagaagatcagcatgctggagaagatctacatccaccccagcctgctgcaggccggctacaagggcagagtgaccggctggggcaacctgaaggagacctggaccgccaacgtgggcaagggccagcccagcgtgctgcaggtggtgaacctgcccatcgtggagagacccgtgtgcaaggacagcaccagaatcagaatcaccgacaacatgttctgcgccggctacaagcccgacgagggcaagagaggcgacgcctgcgagggcgacagcggcggccccttcgtgatgaagagccccttcaacaacagatggtaccagatgggcatcgtgagctggggcgagggctgcgacagagacggcaagtacggcttctacacccacgtgttcagactgaagaagtggatccagaaggtgatcgaccagttcggcgagtag

SEQ ID NO: 1800 - DNA, 888 bp, Artificial Sequence
  Description of Artificial Sequence: Synthetic coding sequence
atggagacccccgcctggcccagagtgcccagacccgagaccgccgtggccagaaccctgctgctgggctgggtgttcgcccaggtggccggcgccagcggcaccaccaacaccgtggccgcctacaacctgacctggaagagcaccaacttcaagaccatcctggagtgggagcccaagcccgtgaaccaggtgtacaccgtgcagatcagcaccaagagcggcgactggaagagcaagtgcttctacaccaccgacaccgagtgcgacctgaccgacgagatcgtgaaggacgtgaagcagacctacctggccagagtgttcagctaccccgccggcaacgtggagagcaccggcagcgccggcgagcccctgtacgagaacagccccgagttcaccccctacctggagaccaacctgggccagcccaccatccagagcttcgagcaggtgggcaccaaggtgaacgtgaccgtggaggacgagagaaccctggtgagaagaaacaacaccttcctgagcctgagagacgtgttcggcaaggacctgatctacaccctgtactactggaagagcagcagcagcggcaagaagaccgccaagaccaacaccaacgagttcctgatcgacgtggacaagggcgagaactactgcttcagcgtgcaggccgtgatccccagcagaaccgtgaacagaaagagcaccgacagccccgtggagtgcatgggccaggagaagggcgagttcagagagatcttctacatcatcggcgccgtggtgttcgtggtgatcatcctggtgatcatcctggccatcagcctgcacaagtgcagaaaggccggcgtgggccagagctggaaggagaacagccccctgaacgtgagctag

SEQ ID NO: 1801 - DNA, 717 bp, Artificial Sequence
  Description of Artificial Sequence: Synthetic coding sequence
atggagacccccgcctggcccagagtgcccagacccgagaccgccgtggccagaaccctgctgctgggctgggtgttcgcccaggtggccggcgccagcggcaccaccaacaccgtggccgcctacaacctgacctggaagagcaccaacttcaagaccatcctggagtgggagcccaagcccgtgaaccaggtgtacaccgtgcagatcagcaccaagagcggcgactggaagagcaagtgcttctacaccaccgacaccgagtgcgacctgaccgacgagatcgtgaaggacgtgaagcagacctacctggccagagtgttcagctaccccgccggcaacgtggagagcaccggcagcgccggcgagcccctgtacgagaacagccccgagttcaccccctacctggagaccaacctgggccagcccaccatccagagcttcgagcaggtgggcaccaaggtgaacgtgaccgtggaggacgagagaaccctggtgagaagaaacaacaccttcctgagcctgagagacgtgttcggcaaggacctgatctacaccctgtactactggaagagcagcagcagcggcaagaagtacagcaccagcctggagctgtggtacctgtggagcagcagcctgagcagcagctggctgtacctgtacaccagcgtggagagacaggagtggggcagagccggcagaagaaccccccactag

SEQ ID NO: 1802 - DNA, 3807 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggcaagacctgcaagaagggcaagaagggccccgccgagaagggcaagggcggcaacggcggcggcaagccccccagcggccccaacagaatgaacggccaccaccagcagaacggcgtggagaacatgatgctgttcgaggtggtgaagatgggcaagagcgccatgcagagcgtggtggacgactggatcgagagctacaagcacgacagagacatcgccctgctggacctgatcaacttcttcatccagtgcagcggctgcaagggcgtggtgaccgccgagatgttcagacacatgcagaacagcgagatcatcagaaagatgaccgaggagttcgacgaggacagcggcgactaccccctgaccatggccggcccccagtggaagaagttcaagagcagcttctgcgagttcatcggcgtgctggtgagacagtgccagtacagcatcatctacgacgagtacatgatggacaccgtgatcagcctgctgaccggcctgagcgacagccaggtgagagccttcagacacaccagcaccctggccgccatgaagctgatgaccgccctggtgaacgtggccctgaacctgagcatcaacatggacaacacccagagacagtacgaggccgagagaaacaagatgatcggcaagagagccaacgagagactggagctgctgctgcagaagagaaaggagctgcaggagaaccaggacgagatcgagaacatgatgaacgccatcttcaagggcgtgttcgtgcacagatacagagacgccatcgccgagatcagagccatctgcatcgaggagatcggcatctggatgaagatgtacagcgacgccttcctgaacgacagctacctgaagtacgtgggctggaccatgcacgacaagcagggcgaggtgagactgaagtgcctgaccgccctgcagggcctgtactacaacaaggagctgaacagcaagctggagctgttcaccagcagattcaaggacagaatcgtgagcatgaccctggacaaggagtacgacgtggccgtgcaggccatcaagctgctgaccctggtgctgcagagcagcgaggaggtgctgaccgccgaggactgcgagaacgtgtaccacctggtgtacagcgcccacagacccgtggccgtggccgccggcgagttcctgtacaagaagctgttcagcagaagagaccccgaggaggacggcatgatgaagagaagaggcagacagggccccaacgccaacctggtgaagaccctggtgttcttcttcctggagagcgagctgcacgagcacgccgcctacctggtggacagcatgtgggactgcgccaccgagctgctgaaggactgggagtgcatgaacagcctgctgctggaggagcccctgagcggcgaggaggccctgaccgacagacaggagagcgccctgatcgagatcatgctgtgcaccatcagacaggccgccgagtgccacccccccgtgggcagaggcaccggcaagagagtgctgaccgccaaggagaagaagacccagctggacgacagaaccaagatcaccgagctgttcgccgtggccctgccccagctgctggccaagtacagcgtggacgccgagaaggtgaccaacctgctgcagctgccccagtacttcgacctggagatctacaccaccggcagactggagaagcacctggacgccctgctgagacagatcagaaacatcgtggagaagcacaccgacaccgacgtgctggaggcctgcagcaagacctaccacgccctgtgcaacgaggagttcaccatcttcaacagagtggacatcagcagaagccagctgatcgacgagctggccgacaagttcaacagactgctggaggacttcctgcaggagggcgaggagcccgacgaggacgacgcctaccaggtgctgagcaccctgaagagaatcaccgccttccacaacgcccacgacctgagcaagtgggacctgttcgcctgcaactacaagctgctgaagaccggcatcgagaacggcgacatgcccgagcagatcgtgatccacgccctgcagtgcacccactacgtgatcctgtggcagctggccaagatcaccgagagcagcagcaccaaggaggacctgctgagactgaagaagcagatgagagtgttctgccagatctgccagcactacctgaccaacgtgaacaccaccgtgaaggagcaggccttcaccatcctgtgcgacatcctgatgatcttcagccaccagatcatgagcggcggcagagacatgctggagcccctggtgtacacccccgacagcagcctgcagagcgagctgctgagcttcatcctggaccacgtgttcatcgagcaggacgacgacaacaacagcgccgacggccagcaggaggacgaggccagcaagatcgaggccctgcacaagagaagaaacctgctggccgccttctgcaagctgatcgtgtacaccgtggtggagatgaacaccgccgccgacatcttcaagcagtacatgaagtactacaacgactacggcgacatcatcaaggagaccatgagcaagaccagacagatcgacaagatccagtgcgccaagaccctgatcctgagcctgcagcagctgttcaacgagatgatccaggagaacggctacaacttcgacagaagcagcagcaccttcagcggcatcaaggagctggccagaagattcgccctgaccttcggcctggaccagctgaagaccagagaggccatcgccatgctgcacaaggacggcatcgagttcgccttcaaggagcccaacccccagggcgagagccacccccccctgaacctggccttcctggacatcctgagcgagttcagcagcaagctgctgagacaggacaagagaaccgtgtacgtgtacctggagaagttcatgaccttccagatgagcctgagaagagaggacgtgtggctgcccctgatgagctacagaaacagcctgctggccggcggcgacgacgacaccatgagcgtgatcagcggcatcagcagcagaggcagcaccgtgagaagcaagaagagcaagcccagcaccggcaagagaaaggtggtggagggcatgcagctgagcctgaccgaggagagcagcagcagcgacagcatgtggctgagcagagagcagaccctgcacacccccgtgatgatgcagaccccccagctgaccagcaccatcatgagagagcccaagagactgagacccgaggacagcttcatgagcgtgtaccccatgcagaccgagcaccaccagacccccctggactacaacacccaggtgacctggatgctggcccagagacagcaggaggaggccagacagcagcaggagagagccgccatgagctacgtgaagctgagaaccaacctgcagcacgccatcagaagaggcaccagcctgatggaggacgacgaggagcccatcgtggaggacgtgatgatgagcagcgagggcagaatcgaggacctgaacgagggcatggacttcgacaccatggacatcgacctgccccccagcaagaacagaagagagagaaccgagctgaagcccgacttcttcgaccccgccagcatcatggacgagagcgtgctgggcgtgagcatgttctag

SEQ ID NO: 1803 - DNA, 1272 bp, Artificial Sequence
  Description of Artificial Sequence: Synthetic coding sequence
atgcagagagtgaacatgatcatggccgagagccccggcctgatcaccatctgcctgctgggctacctgctgagcgccgagtgcaccgtgttcctggaccacgagaacgccaacaagatcctgaacagacccaagagatacaacagcggcaagctggaggagttcgtgcagggcaacctggagagagagtgcatggaggagaagtgcagcttcgaggaggccagagaggtgttcgagaacaccgagagaaccaccgagttctggaagcagtacgtggacgtgacctgcaacatcaagaacggcagatgcgagcagttctgcaagaacagcgccgacaacaaggtggtgtgcagctgcaccgagggctacagactggccgagaaccagaagagctgcgagcccgccgtgcccttcccctgcggcagagtgagcgtgagccagaccagcaagctgaccagagccgagaccgtgttccccgacgtggactacgtgaacagcaccgaggccgagaccatcctggacaacatcacccagagcacccagagcttcaacgacttcaccagagtggtgggcggcgaggacgccaagcccggccagttcccctggcaggtggtgctgaacggcaaggtggacgccttctgcggcggcagcatcgtgaacgagaagtggatcgtgaccgccgcccactgcgtggagaccggcgtgaagatcaccgtggtggccggcgagcacaacatcgaggagaccgagcacaccgagcagaagagaaacgtgatcagaatcatcccccaccacaactacaacgccgccatcaacaagtacaaccacgacatcgccctgctggagctggacgagcccctggtgctgaacagctacgtgacccccatctgcatcgccgacaaggagtacaccaacatcttcctgaagttcggcagcggctacgtgagcggctggggcagagtgttccacaagggcagaagcgccctggtgctgcagtacctgagagtgcccctggtggacagagccacctgcctgagaagcaccaagttcaccatctacaacaacatgttctgcgccggcttccacgagggcggcagagacagctgccagggcgacagcggcggcccccacgtgaccgaggtggagggcaccagcttcctgaccggcatcatcagctggggcgaggagtgcgccatgaagggcaagtacggcatctacaccaaggtgagcagatacgtgaactggatcaaggagaagaccaagctgacctag

SEQ ID NO: 1804 - DNA, 6690 bp, Artificial Sequence
  Description of Artificial Sequence: Synthetic coding sequence
atgttccccggctgccccagactgtgggtgctggtggtgctgggcaccagctgggtgggctggggcagccagggcaccgaggccgcccagctgagacagttctacgtggccgcccagggcatcagctggagctacagacccgagcccaccaacagcagcctgaacctgagcgtgaccagcttcaagaagatcgtgtacagagagtacgagccctacttcaagaaggagaagccccagagcaccatcagcggcctgctgggccccaccctgtacgccgaggtgggcgacatcatcaaggtgcacttcaagaacaaggccgacaagcccctgagcatccacccccagggcatcagatacagcaagctgagcgagggcgccagctacctggaccacaccttccccgccgagaagatggacgacgccgtggcccccggcagagagtacacctacgagtggagcatcagcgaggacagcggccccacccacgacgaccccccctgcctgacccacatctactacagccacgagaacctgatcgaggacttcaacagcggcctgatcggccccctgctgatctgcaagaagggcaccctgaccgagggcggcacccagaagaccttcgacaagcagatcgtgctgctgttcgccgtgttcgacgagagcaagagctggagccagagcagcagcctgatgtacaccgtgaacggctacgtgaacggcaccatgcccgacatcaccgtgtgcgcccacgaccacatcagctggcacctgctgggcatgagcagcggccccgagctgttcagcatccacttcaacggccaggtgctggagcagaaccaccacaaggtgagcgccatcaccctggtgagcgccaccagcaccaccgccaacatgaccgtgggccccgagggcaagtggatcatcagcagcctgacccccaagcacctgcaggccggcatgcaggcctacatcgacatcaagaactgccccaagaagaccagaaacctgaagaagatcaccagagagcagagaagacacatgaagagatgggagtacttcatcgccgccgaggaggtgatctgggactacgcccccgtgatccccgccaacatggacaagaagtacagaagccagcacctggacaacttcagcaaccagatcggcaagcactacaagaaggtgatgtacacccagtacgaggacgagagcttcaccaagcacaccgtgaaccccaacatgaaggaggacggcatcctgggccccatcatcagagcccaggtgagagacaccctgaagatcgtgttcaagaacatggccagcagaccctacagcatctacccccacggcgtgaccttcagcccctacgaggacgaggtgaacagcagcttcaccagcggcagaaacaacaccatgatcagagccgtgcagcccggcgagacctacacctacaagtggaacatcctggagttcgacgagcccaccgagaacgacgcccagtgcctgaccagaccctactacagcgacgtggacatcatgagagacatcgccagcggcctgatcggcctgctgctgatctgcaagagcagaagcctggacagacagggcatccagagagccgccgacatcgagcagcaggccgtgttcgccgtgttcgacgagaacaagagctggtacctggaggacaacatcaacaagttctgcgagaaccccgacgaggtgaagagagacgaccccaagttctacgagagcaacatcatgagcaacttcaccctgagcgccatcaacggctacgtgcccgagagcatcaccaccctgggcttctgcttcgacgacaccgtgcagtggcacttctgcagcgtgggcacccagaacgagatcctgaccatccacttcaccggccacagcttcatctacggcaagagacacgaggacaccctgaccctgttccccatgagaggcgagagcgtgaccgtgaccatggacaacgtgggcacctggatgctgaccagcatgaacagcagccccagaagcaagaagctgagactgaagttcagagacgtgaagtgcatccccgacgacgacgaggacagctacgagatcttcgagccccccgagagcaccgtgatggccaccagaaagatgcacgacagactggagcccgaggacgaggagagcgacgccgactacgactaccagaacagactggccgccgccctgggcatcagaagcttcagaaacagcagcctgaaccaggaggaggaggagttcaacctgaccgccctggccctggagaacggcaccgagttcgtgagcagcaacaccgacatcatcgtgggcagcaactacagcagccccagcaacatcagcaagttcaccgtgaacaacctggccgagccccagaaggcccccagccaccagcaggccaccaccgccggcagccccctgagacacctgatcggcaagaacagcgtgctgaacagcagcaccgccgagcacagcagcccctacagcgaggaccccatcgaggaccccctgcagcccgacgtgaccggcatcagactgctgagcctgggcgccggcgagttcaagagccaggagcacgccaagcacaagggccccaaggtggagagagaccaggccgccaagcacagattcagctggatgaagctgctggcccacaaggtgggcagacacctgagccaggacaccggcagccccagcggcatgagaccctgggaggacctgcccagccaggacaccggcagccccagcagaatgagaccctggaaggacccccccagcgacctgctgctgctgaagcagagcaacagcagcaagatcctggtgggcagatggcacctggccagcgagaagggcagctacgagatcatccaggacaccgacgaggacaccgccgtgaacaactggctgatcagcccccagaacgccagcagagcctggggcgagagcacccccctggccaacaagcccggcaagcagagcggccaccccaagttccccagagtgagacacaagagcctgcaggtgagacaggacggcggcaagagcagactgaagaagagccagttcctgatcaagaccagaaagaagaagaaggagaagcacacccaccacgcccccctgagccccagaaccttccaccccctgagaagcgaggcctacaacaccttcagcgagagaagactgaagcacagcctggtgctgcacaagagcaacgagaccagcctgcccaccgacctgaaccagaccctgcccagcatggacttcggctggatcgccagcctgcccgaccacaaccagaacagcagcaacgacaccggccaggccagctgcccccccggcctgtaccagaccgtgccccccgaggagcactaccagaccttccccatccaggaccccgaccagatgcacagcaccagcgaccccagccacagaagcagcagccccgagctgagcgagatgctggagtacgacagaagccacaagagcttccccaccgacatcagccagatgagccccagcagcgagcacgaggtgtggcagaccgtgatcagccccgacctgagccaggtgaccctgagccccgagctgagccagaccaacctgagccccgacctgagccacaccaccctgagccccgagctgatccagagaaacctgagccccgccctgggccagatgcccatcagccccgacctgagccacaccaccctgagccccgacctgagccacaccaccctgagcctggacctgagccagaccaacctgagccccgagctgagccagaccaacctgagccccgccctgggccagatgcccctgagccccgacctgagccacaccaccctgagcctggacttcagccagaccaacctgagccccgagctgagccacatgaccctgagccccgagctgagccagaccaacctgagccccgccctgggccagatgcccatcagccccgacctgagccacaccaccctgagcctggacttcagccagaccaacctgagccccgagctgagccagaccaacctgagccccgccctgggccagatgcccctgagccccgaccccagccacaccaccctgagcctggacctgagccagaccaacctgagccccgagctgagccagaccaacctgagccccgacctgagcgagatgcccctgttcgccgacctgagccagatccccctgacccccgacctggaccagatgaccctgagccccgacctgggcgagaccgacctgagccccaacttcggccagatgagcctgagccccgacctgagccaggtgaccctgagccccgacatcagcgacaccaccctgctgcccgacctgagccagatcagccccccccccgacctggaccagatcttctaccccagcgagagcagccagagcctgctgctgcaggagttcaacgagagcttcccctaccccgacctgggccagatgcccagccccagcagccccaccctgaacgacaccttcctgagcaaggagttcaaccccctggtgatcgtgggcctgagcaaggacggcaccgactacatcgagatcatccccaaggaggaggtgcagagcagcgaggacgactacgccgagatcgactacgtgccctacgacgacccctacaagaccgacgtgagaaccaacatcaacagcagcagagaccccgacaacatcgccgcctggtacctgagaagcaacaacggcaacagaagaaactactacatcgccgccgaggagatcagctgggactacagcgagttcgtgcagagagagaccgacatcgaggacagcgacgacatccccgaggacaccacctacaagaaggtggtgttcagaaagtacctggacagcaccttcaccaagagagaccccagaggcgagtacgaggagcacctgggcatcctgggccccatcatcagagccgaggtggacgacgtgatccaggtgagattcaagaacctggccagcagaccctacagcctgcacgcccacggcctgagctacgagaagagcagcgagggcaagacctacgaggacgacagccccgagtggttcaaggaggacaacgccgtgcagcccaacagcagctacacctacgtgtggcacgccaccgagagaagcggccccgagagccccggcagcgcctgcagagcctgggcctactacagcgccgtgaaccccgagaaggacatccacagcggcctgatcggccccctgctgatctgccagaagggcatcctgcacaaggacagcaacatgcccatggacatgagagagttcgtgctgctgttcatgaccttcgacgagaagaagagctggtactacgagaagaagagcagaagcagctggagactgaccagcagcgagatgaagaagagccacgagttccacgccatcaacggcatgatctacagcctgcccggcctgaagatgtacgagcaggagtgggtgagactgcacctgctgaacatcggcggcagccaggacatccacgtggtgcacttccacggccagaccctgctggagaacggcaacaagcagcaccagctgggcgtgtggcccctgctgcccggcagcttcaagaccctggagatgaaggccagcaagcccggctggtggctgctgaacaccgaggtgggcgagaaccagagagccggcatgcagacccccttcctgatcatggacagagactgcagaatgcccatgggcctgagcaccggcatcatcagcgacagccagatcaaggccagcgagttcctgggctactgggagcccagactggccagactgaacaacggcggcagctacaacgcctggagcgtggagaagctggccgccgagttcgccagcaagccctggatccaggtggacatgcagaaggaggtgatcatcaccggcatccagacccagggcgccaagcactacctgaagagctgctacaccaccgagttctacgtggcctacagcagcaaccagatcaactggcagatcttcaagggcaacagcaccagaaacgtgatgtacttcaacggcaacagcgacgccagcaccatcaaggagaaccagttcgacccccccatcgtggccagatacatcagaatcagccccaccagagcctacaacagacccaccctgagactggagctgcagggctgcgaggtgaacggctgcagcacccccctgggcatggagaacggcaagatcgagaacaagcagatcaccgccagcagcttcaagaagagctggtggggcgactactgggagcccttcagagccagactgaacgcccagggcagagtgaacgcctggcaggccaaggccaacaacaacaagcagtggctggagatcgacctgctgaagatcaagaagatcaccgccatcatcacccagggctgcaagagcctgagcagcgagatgtacgtgaagagctacaccatccactacagcgagcagggcgtggagtggaagccctacagactgaagagcagcatggtggacaagatcttcgagggcaacaccaacaccaagggccacgtgaagaacttcttcaacccccccatcatcagcagattcatcagagtgatccccaagacctggaaccagagcatcgccctgagactggagctgttcggctgcgacatctactag

SEQ ID NO: 1805 - DNA, 6675 bp, Artificial Sequence
  Description of Artificial Sequence: Synthetic coding sequence
atgttccccggctgccccagactgtgggtgctggtggtgctgggcaccagctgggtgggctggggcagccagggcaccgaggccgcccagctgagacagttctacgtggccgcccagggcatcagctggagctacagacccgagcccaccaacagcagcctgaacctgagcgtgaccagcttcaagaagatcgtgtacagagagtacgagccctacttcaagaaggagaagccccagagcaccatcagcggcctgctgggccccaccctgtacgccgaggtgggcgacatcatcaaggtgcacttcaagaacaaggccgacaagcccctgagcatccacccccagggcatcagatacagcaagctgagcgagggcgccagctacctggaccacaccttccccgccgagaagatggacgacgccgtggcccccggcagagagtacacctacgagtggagcatcagcgaggacagcggccccacccacgacgaccccccctgcctgacccacatctactacagccacgagaacctgatcgaggacttcaacagcggcctgatcggccccctgctgatctgcaagaagggcaccctgaccgagggcggcacccagaagaccttcgacaagcagatcgtgctgctgttcgccgtgttcgacgagagcaagagctggagccagagcagcagcctgatgtacaccgtgaacggctacgtgaacggcaccatgcccgacatcaccgtgtgcgcccacgaccacatcagctggcacctgctgggcatgagcagcggccccgagctgttcagcatccacttcaacggccaggtgctggagcagaaccaccacaaggtgagcgccatcaccctggtgagcgccaccagcaccaccgccaacatgaccgtgggccccgagggcaagtggatcatcagcagcctgacccccaagcacctgcaggccggcatgcaggcctacatcgacatcaagaactgccccaagaagaccagaaacctgaagaagatcaccagagagcagagaagacacatgaagagatgggagtacttcatcgccgccgaggaggtgatctgggactacgcccccgtgatccccgccaacatggacaagaagtacagaagccagcacctggacaacttcagcaaccagatcggcaagcactacaagaaggtgatgtacacccagtacgaggacgagagcttcaccaagcacaccgtgaaccccaacatgaaggaggacggcatcctgggccccatcatcagagcccaggtgagagacaccctgaagatcgtgttcaagaacatggccagcagaccctacagcatctacccccacggcgtgaccttcagcccctacgaggacgaggtgaacagcagcttcaccagcggcagaaacaacaccatgatcagagccgtgcagcccggcgagacctacacctacaagtggaacatcctggagttcgacgagcccaccgagaacgacgcccagtgcctgaccagaccctactacagcgacgtggacatcatgagagacatcgccagcggcctgatcggcctgctgctgatctgcaagagcagaagcctggacagacagggcatccagagagccgccgacatcgagcagcaggccgtgttcgccgtgttcgacgagaacaagagctggtacctggaggacaacatcaacaagttctgcgagaaccccgacgaggtgaagagagacgaccccaagttctacgagagcaacatcatgagcaccatcaacggctacgtgcccgagagcatcaccaccctgggcttctgcttcgacgacaccgtgcagtggcacttctgcagcgtgggcacccagaacgagatcctgaccatccacttcaccggccacagcttcatctacggcaagagacacgaggacaccctgaccctgttccccatgagaggcgagagcgtgaccgtgaccatggacaacgtgggcacctggatgctgaccagcatgaacagcagccccagaagcaagaagctgagactgaagttcagagacgtgaagtgcatccccgacgacgacgaggacagctacgagatcttcgagccccccgagagcaccgtgatggccaccagaaagatgcacgacagactggagcccgaggacgaggagagcgacgccgactacgactaccagaacagactggccgccgccctgggcatcagaagcttcagaaacagcagcctgaaccaggaggaggaggagttcaacctgaccgccctggccctggagaacggcaccgagttcgtgagcagcaacaccgacatcatcgtgggcagcaactacagcagccccagcaacatcagcaagttcaccgtgaacaacctggccgagccccagaaggcccccagccaccagcaggccaccaccgccggcagccccctgagacacctgatcggcaagaacagcgtgctgaacagcagcaccgccgagcacagcagcccctacagcgaggaccccatcgaggaccccctgcagcccgacgtgaccggcatcagactgctgagcctgggcgccggcgagttcaagagccaggagcacgccaagcacaagggccccaaggtggagagagaccaggccgccaagcacagattcagctggatgaagctgctggcccacaaggtgggcagacacctgagccaggacaccggcagccccagcggcatgagaccctgggaggacctgcccagccaggacaccggcagccccagcagaatgagaccctggaaggacccccccagcgacctgctgctgctgaagcagagcaacagcagcaagatcctggtgggcagatggcacctggccagcgagaagggcagctacgagatcatccaggacaccgacgaggacaccgccgtgaacaactggctgatcagcccccagaacgccagcagagcctggggcgagagcacccccctggccaacaagcccggcaagcagagcggccaccccaagttccccagagtgagacacaagagcctgcaggtgagacaggacggcggcaagagcagactgaagaagagccagttcctgatcaagaccagaaagaagaagaaggagaagcacacccaccacgcccccctgagccccagaaccttccaccccctgagaagcgaggcctacaacaccttcagcgagagaagactgaagcacagcctggtgctgcacaagagcaacgagaccagcctgcccaccgacctgaaccagaccctgcccagcatggacttcggctggatcgccagcctgcccgaccacaaccagaacagcagcaacgacaccggccaggccagctgcccccccggcctgtaccagaccgtgccccccgaggagcactaccagaccttccccatccaggaccccgaccagatgcacagcaccagcgaccccagccacagaagcagcagccccgagctgagcgagatgctggagtacgacagaagccacaagagcttccccaccgacatcagccagatgagccccagcagcgagcacgaggtgtggcagaccgtgatcagccccgacctgagccaggtgaccctgagccccgagctgagccagaccaacctgagccccgacctgagccacaccaccctgagccccgagctgatccagagaaacctgagccccgccctgggccagatgcccatcagccccgacctgagccacaccaccctgagccccgacctgagccacaccaccctgagcctggacctgagccagaccaacctgagccccgagctgagccagaccaacctgagccccgccctgggccagatgcccctgagccccgacctgagccacaccaccctgagcctggacttcagccagaccaacctgagccccgagctgagccacatgaccctgagccccgagctgagccagaccaacctgagccccgccctgggccagatgcccatcagccccgacctgagccacaccaccctgagcctggacttcagccagaccaacctgagccccgagctgagccagaccaacctgagccccgccctgggccagatgcccctgagccccgaccccagccacaccaccctgagcctggacctgagccagaccaacctgagccccgagctgagccagaccaacctgagccccgacctgagcgagatgcccctgttcgccgacctgagccagatccccctgacccccgacctggaccagatgaccctgagccccgacctgggcgagaccgacctgagccccaacttcggccagatgagcctgagccccgacctgagccaggtgaccctgagccccgacatcagcgacaccaccctgctgcccgacctgagccagatcagccccccccccgacctggaccagatcttctaccccagcgagagcagccagagcctgctgctgcaggagttcaacgagagcttcccctaccccgacctgggccagatgcccagccccagcagccccaccctgaacgacaccttcctgagcaaggagttcaaccccctggtgatcgtgggcctgagcaaggacggcaccgactacatcgagatcatccccaaggaggaggtgcagagcagcgaggacgactacgccgagatcgactacgtgccctacgacgacccctacaagaccgacgtgagaaccaacatcaacagcagcagagaccccgacaacatcgccgcctggtacctgagaagcaacaacggcaacagaagaaactactacatcgccgccgaggagatcagctgggactacagcgagttcgtgcagagagagaccgacatcgaggacagcgacgacatccccgaggacaccacctacaagaaggtggtgttcagaaagtacctggacagcaccttcaccaagagagaccccagaggcgagtacgaggagcacctgggcatcctgggccccatcatcagagccgaggtggacgacgtgatccaggtgagattcaagaacctggccagcagaccctacagcctgcacgcccacggcctgagctacgagaagagcagcgagggcaagacctacgaggacgacagccccgagtggttcaaggaggacaacgccgtgcagcccaacagcagctacacctacgtgtggcacgccaccgagagaagcggccccgagagccccggcagcgcctgcagagcctgggcctactacagcgccgtgaaccccgagaaggacatccacagcggcctgatcggccccctgctgatctgccagaagggcatcctgcacaaggacagcaacatgcccatggacatgagagagttcgtgctgctgttcatgaccttcgacgagaagaagagctggtactacgagaagaagagcagaagcagctggagactgaccagcagcgagatgaagaagagccacgagttccacgccatcaacggcatgatctacagcctgcccggcctgaagatgtacgagcaggagtgggtgagactgcacctgctgaacatcggcggcagccaggacatccacgtggtgcacttccacggccagaccctgctggagaacggcaacaagcagcaccagctgggcgtgtggcccctgctgcccggcagcttcaagaccctggagatgaaggccagcaagcccggctggtggctgctgaacaccgaggtgggcgagaaccagagagccggcatgcagacccccttcctgatcatggacagagactgcagaatgcccatgggcctgagcaccggcatcatcagcgacagccagatcaaggccagcgagttcctgggctactgggagcccagactggccagactgaacaacggcggcagctacaacgcctggagcgtggagaagctggccgccgagttcgccagcaagccctggatccaggtggacatgcagaaggaggtgatcatcaccggcatccagacccagggcgccaagcactacctgaagagctgctacaccaccgagttctacgtggcctacagcagcaaccagatcaactggcagatcttcaagggcaacagcaccagaaacgtgatgtacttcaacggcaacagcgacgccagcaccatcaaggagaaccagttcgacccccccatcgtggccagatacatcagaatcagccccaccagagcctacaacagacccaccctgagactggagctgcagggctgcgaggtgaacggctgcagcacccccctgggcatggagaacggcaagatcgagaacaagcagatcaccgccagcagcttcaagaagagctggtggggcgactactgggagcccttcagagccagactgaacgcccagggcagagtgaacgcctggcaggccaaggccaacaacaacaagcagtggctggagatcgacctgctgaagatcaagaagatcaccgccatcatcacccagggctgcaagagcctgagcagcgagatgtacgtgaagagctacaccatccactacagcgagcagggcgtggagtggaagccctacagactgaagagcagcatggtggacaagatcttcgagggcaacaccaacaccaagggccacgtgaagaacttcttcaacccccccatcatcagcagattcatcagagtgatccccaagacctggaaccagagcatcgccctgagactggagctgttcggctgcgacatctactag

SEQ ID NO: 1806 - DNA, 999 bp, Artificial Sequence
  Description of Artificial Sequence: Synthetic coding sequence
atggacgacgccgtggcccccggcagagagtacacctacgagtggagcatcagcgaggacagcggccccacccacgacgaccccccctgcctgacccacatctactacagccacgagaacctgatcgaggacttcaacagcggcctgatcggccccctgctgatctgcaagaagggcaccctgaccgagggcggcacccagaagaccttcgacaagcagatcgtgctgctgttcgccgtgttcgacgagagcaagagctggagccagagcagcagcctgatgtacaccgtgaacggctacgtgaacggcaccatgcccgacatcaccgtgtgcgcccacgaccacatcagctggcacctgctgggcatgagcagcggccccgagctgttcagcatccacttcaacggccaggtgctggagcagaaccaccacaaggtgagcgccatcaccctggtgagcgccaccagcaccaccgccaacatgaccgtgggccccgagggcaagtggatcatcagcagcctgacccccaagcacctgcaggccggcatgcaggcctacatcgacatcaagaactgccccaagaagaccagaaacctgaagaagatcaccagagagcagagaagacacatgaagagatgggagtacttcatcgccgccgaggaggtgatctgggactacgcccccgtgatccccgccaacatggacaagaagtacagaagccagcacctggacaacttcagcaaccagatcggcaagcactacaagaaggtgatgtacacccagtacgaggacgagagcttcaccaagcacaccgtgaaccccaacatgaaggaggacggcatcctgggccccatcatcagagcccaggtgagagacaccctgaagatcgtgttcaagaacatggccagcagaccctacagcatctacccccacggcgtgaccttcagcccctacgaggacgaggtgaacagcagcttcaccagcggcaccaccccctag

SEQ ID NO: 1807 - DNA, 1335 bp, Artificial Sequence
  Description of Artificial Sequence: Synthetic coding sequence
atggtgagccaggccctgagactgctgtgcctgctgctgggcctgcagggctgcctggccgccgtgttcgtgacccaggaggaggcccacggcgtgctgcacagaagaagaagagccaacgccttcctggaggagctgagacccggcagcctggagagagagtgcaaggaggagcagtgcagcttcgaggaggccagagagatcttcaaggacgccgagagaaccaagctgttctggatcagctacagcgacggcgaccagtgcgccagcagcccctgccagaacggcggcagctgcaaggaccagctgcagagctacatctgcttctgcctgcccgccttcgagggcagaaactgcgagacccacaaggacgaccagctgatctgcgtgaacgagaacggcggctgcgagcagtactgcagcgaccacaccggcaccaagagaagctgcagatgccacgagggctacagcctgctggccgacggcgtgagctgcacccccaccgtggagtacccctgcggcaagatccccatcctggagaagagaaacgccagcaagccccagggcagaatcgtgggcggcaaggtgtgccccaagggcgagtgcccctggcaggtgctgctgctggtgaacggcgcccagctgtgcggcggcaccctgatcaacaccatctgggtggtgagcgccgcccactgcttcgacaagatcaagaactggagaaacctgatcgccgtgctgggcgagcacgacctgagcgagcacgacggcgacgagcagagcagaagagtggcccaggtgatcatccccagcacctacgtgcccggcaccaccaaccacgacatcgccctgctgagactgcaccagcccgtggtgctgaccgaccacgtggtgcccctgtgcctgcccgagagaaccttcagcgagagaaccctggccttcgtgagattcagcctggtgagcggctggggccagctgctggacagaggcgccaccgccctggagctgatggtgctgaacgtgcccagactgatgacccaggactgcctgcagcagagcagaaaggtgggcgacagccccaacatcaccgagtacatgttctgcgccggctacagcgacggcagcaaggacagctgcaagggcgacagcggcggcccccacgccacccactacagaggcacctggtacctgaccggcatcgtgagctggggccagggctgcgccaccgtgggccacttcggcgtgtacaccagagtgagccagtacatcgagtggctgcagaagctgatgagaagcgagcccagacccggcgtgctgctgagagcccccttcccctag

SEQ ID NO: 1808 - DNA, 1401 bp, Artificial Sequence
  Description of Artificial Sequence: Synthetic coding sequence
atggtgagccaggccctgagactgctgtgcctgctgctgggcctgcagggctgcctggccgccggcggcgtggccaaggccagcggcggcgagaccagagacatgccctggaagcccggcccccacagagtgttcgtgacccaggaggaggcccacggcgtgctgcacagaagaagaagagccaacgccttcctggaggagctgagacccggcagcctggagagagagtgcaaggaggagcagtgcagcttcgaggaggccagagagatcttcaaggacgccgagagaaccaagctgttctggatcagctacagcgacggcgaccagtgcgccagcagcccctgccagaacggcggcagctgcaaggaccagctgcagagctacatctgcttctgcctgcccgccttcgagggcagaaactgcgagacccacaaggacgaccagctgatctgcgtgaacgagaacggcggctgcgagcagtactgcagcgaccacaccggcaccaagagaagctgcagatgccacgagggctacagcctgctggccgacggcgtgagctgcacccccaccgtggagtacccctgcggcaagatccccatcctggagaagagaaacgccagcaagccccagggcagaatcgtgggcggcaaggtgtgccccaagggcgagtgcccctggcaggtgctgctgctggtgaacggcgcccagctgtgcggcggcaccctgatcaacaccatctgggtggtgagcgccgcccactgcttcgacaagatcaagaactggagaaacctgatcgccgtgctgggcgagcacgacctgagcgagcacgacggcgacgagcagagcagaagagtggcccaggtgatcatccccagcacctacgtgcccggcaccaccaaccacgacatcgccctgctgagactgcaccagcccgtggtgctgaccgaccacgtggtgcccctgtgcctgcccgagagaaccttcagcgagagaaccctggccttcgtgagattcagcctggtgagcggctggggccagctgctggacagaggcgccaccgccctggagctgatggtgctgaacgtgcccagactgatgacccaggactgcctgcagcagagcagaaaggtgggcgacagccccaacatcaccgagtacatgttctgcgccggctacagcgacggcagcaaggacagctgcaagggcgacagcggcggcccccacgccacccactacagaggcacctggtacctgaccggcatcgtgagctggggccagggctgcgccaccgtgggccacttcggcgtgtacaccagagtgagccagtacatcgagtggctgcagaagctgatgagaagcgagcccagacccggcgtgctgctgagagcccccttcccctag

SEQ ID NO: 1809 - DNA, 1194 bp, Artificial Sequence
  Description of Artificial Sequence: Synthetic coding sequence
atgggcaacgtgaacagacagggccagcactgcagagacttcatcatggtgagccaggccctgagactgctgtgcctgctgctgggcctgcagggctgcctggccgccgacggcgaccagtgcgccagcagcccctgccagaacggcggcagctgcaaggaccagctgcagagctacatctgcttctgcctgcccgccttcgagggcagaaactgcgagacccacaaggacgaccagctgatctgcgtgaacgagaacggcggctgcgagcagtactgcagcgaccacaccggcaccaagagaagctgcagatgccacgagggctacagcctgctggccgacggcgtgagctgcacccccaccgtggagtacccctgcggcaagatccccatcctggagaagagaaacgccagcaagccccagggcagaatcgtgggcggcaaggtgtgccccaagggcgagtgcccctggcaggtgctgctgctggtgaacggcgcccagctgtgcggcggcaccctgatcaacaccatctgggtggtgagcgccgcccactgcttcgacaagatcaagaactggagaaacctgatcgccgtgctgggcgagcacgacctgagcgagcacgacggcgacgagcagagcagaagagtggcccaggtgatcatccccagcacctacgtgcccggcaccaccaaccacgacatcgccctgctgagactgcaccagcccgtggtgctgaccgaccacgtggtgcccctgtgcctgcccgagagaaccttcagcgagagaaccctggccttcgtgagattcagcctggtgagcggctggggccagctgctggacagaggcgccaccgccctggagctgatggtgctgaacgtgcccagactgatgacccaggactgcctgcagcagagcagaaaggtgggcgacagccccaacatcaccgagtacatgttctgcgccggctacagcgacggcagcaaggacagctgcaagggcgacagcggcggcccccacgccacccactacagaggcacctggtacctgaccggcatcgtgagctggggccagggctgcgccaccgtgggccacttcggcgtgtacaccagagtgagccagtacatcgagtggctgcagaagctgatgagaagcgagcccagacccggcgtgctgctgagagcccccttcccctag

SEQ ID NO: 1810 - DNA, 651 bp, Artificial Sequence
  Description of Artificial Sequence: Synthetic coding sequence
atgagaatccaggaccccggcaaggtgttcttcggcaacgtggacagcagcggcatcaagcacaacatcttcaacccccccatcatcgccagatacatcagactgcaccccacccactacagcatcagaagcaccctgagaatggagctgatgggctgcgacctgaacagctgcagcatgcccctgggcatggagagcaaggccatcagcgacgcccagatcaccgccagcagctacttcaccaacatgttcgccacctggagccccagcaaggccagactgcacctgcagggcagaagcaacgcctggagaccccaggtgaacaaccccaaggagtggctgcaggtggacttccagaagaccatgaaggtgaccggcgtgaccacccagggcgtgaagagcctgctgaccagcatgtacgtgaaggagttcctgatcagcagcagccaggacggccaccagtggaccctgttcttccagaacggcaaggtgaaggtgttccagggcaaccaggacagcttcacccccgtggtgaacagcctggacccccccctgctgaccagatacctgagaatccacccccagagctgggtgcaccagatcgccctgagaatggaggtgctgggctgcgaggcccaggacctgtactag

SEQ ID NO: 1811 - DNA, 7056 bp, Artificial Sequence
  Description of Artificial Sequence: Synthetic coding sequence
atgcagatcgagctgagcacctgcttcttcctgtgcctgctgagattctgcttcagcgccaccagaagatactacctgggcgccgtggagctgagctgggactacatgcagagcgacctgggcgagctgcccgtggacgccagattcccccccagagtgcccaagagcttccccttcaacaccagcgtggtgtacaagaagaccctgttcgtggagttcaccgaccacctgttcaacatcgccaagcccagacccccctggatgggcctgctgggccccaccatccaggccgaggtgtacgacaccgtggtgatcaccctgaagaacatggccagccaccccgtgagcctgcacgccgtgggcgtgagctactggaaggccagcgagggcgccgagtacgacgaccagaccagccagagagagaaggaggacgacaaggtgttccccggcggcagccacacctacgtgtggcaggtgctgaaggagaacggccccatggccagcgaccccctgtgcctgacctacagctacctgagccacgtggacctggtgaaggacctgaacagcggcctgatcggcgccctgctggtgtgcagagagggcagcctggccaaggagaagacccagaccctgcacaagttcatcctgctgttcgccgtgttcgacgagggcaagagctggcacagcgagaccaagaacagcctgatgcaggacagagacgccgccagcgccagagcctggcccaagatgcacaccgtgaacggctacgtgaacagaagcctgcccggcctgatcggctgccacagaaagagcgtgtactggcacgtgatcggcatgggcaccacccccgaggtgcacagcatcttcctggagggccacaccttcctggtgagaaaccacagacaggccagcctggagatcagccccatcaccttcctgaccgcccagaccctgctgatggacctgggccagttcctgctgttctgccacatcagcagccaccagcacgacggcatggaggcctacgtgaaggtggacagctgccccgaggagccccagctgagaatgaagaacaacgaggaggccgaggactacgacgacgacctgaccgacagcgagatggacgtggtgagattcgacgacgacaacagccccagcttcatccagatcagaagcgtggccaagaagcaccccaagacctgggtgcactacatcgccgccgaggaggaggactgggactacgcccccctggtgctggcccccgacgacagaagctacaagagccagtacctgaacaacggcccccagagaatcggcagaaagtacaagaaggtgagattcatggcctacaccgacgagaccttcaagaccagagaggccatccagcacgagagcggcatcctgggccccctgctgtacggcgaggtgggcgacaccctgctgatcatcttcaagaaccaggccagcagaccctacaacatctacccccacggcatcaccgacgtgagacccctgtacagcagaagactgcccaagggcgtgaagcacctgaaggacttccccatcctgcccggcgagatcttcaagtacaagtggaccgtgaccgtggaggacggccccaccaagagcgaccccagatgcctgaccagatactacagcagcttcgtgaacatggagagagacctggccagcggcctgatcggccccctgctgatctgctacaaggagagcgtggaccagagaggcaaccagatcatgagcgacaagagaaacgtgatcctgttcagcgtgttcgacgagaacagaagctggtacctgaccgagaacatccagagattcctgcccaaccccgccggcgtgcagctggaggaccccgagttccaggccagcaacatcatgcacagcatcaacggctacgtgttcgacagcctgcagctgagcgtgtgcctgcacgaggtggcctactggtacatcctgagcatcggcgcccagaccgacttcctgagcgtgttcttcagcggctacaccttcaagcacaagatggtgtacgaggacaccctgaccctgttccccttcagcggcgagaccgtgttcatgagcatggagaaccccggcctgtggatcctgggctgccacaacagcgacttcagaaacagaggcatgaccgccctgctgaaggtgagcagctgcgacaagaacaccggcgactactacgaggacagctacgaggacatcagcgcctacctgctgagcaagaacaacgccatcgagcccagaagcttcagccagaacagcagacaccccagcaccagacagaagcagttcaacgccaccaccatccccgagaacgacatcgagaagaccgacccctggttcgcccacagaacccccatgcccaagatccagaacgtgagcagcagcgacctgctgatgctgctgagacagagccccaccccccacggcctgagcctgagcgacctgcaggaggccaagtacgagaccttcagcgacgaccccagccccggcgccatcgacagcaacaacagcctgagcgagatgacccacttcagaccccagctgcaccacagcggcgacatggtgttcacccccgagagcggcctgcagctgagactgaacgagaagctgggcaccaccgccgccaccgagctgaagaagctggacttcaaggtgagcagcaccagcaacaacctgatcagcaccatccccagcgacaacctggccgccggcaccgacaacaccagcagcctgggcccccccagcatgcccgtgcactacgacagccagctggacaccaccctgttcggcaagaagagcagccccctgaccgagagcggcggccccctgagcctgagcgaggagaacaacgacagcaagctgctggagagcggcctgatgaacagccaggagagcagctggggcaagaacgtgagcagcaccgagagcggcagactgttcaagggcaagagagcccacggccccgccctgctgaccaaggacaacgccctgttcaaggtgagcatcagcctgctgaagaccaacaagaccagcaacaacagcgccaccaacagaaagacccacatcgacggccccagcctgctgatcgagaacagccccagcgtgtggcagaacatcctggagagcgacaccgagttcaagaaggtgacccccctgatccacgacagaatgctgatggacaagaacgccaccgccctgagactgaaccacatgagcaacaagaccaccagcagcaagaacatggagatggtgcagcagaagaaggagggccccatcccccccgacgcccagaaccccgacatgagcttcttcaagatgctgttcctgcccgagagcgccagatggatccagagaacccacggcaagaacagcctgaacagcggccagggccccagccccaagcagctggtgagcctgggccccgagaagagcgtggagggccagaacttcctgagcgagaagaacaaggtggtggtgggcaagggcgagttcaccaaggacgtgggcctgaaggagatggtgttccccagcagcagaaacctgttcctgaccaacctggacaacctgcacgagaacaacacccacaaccaggagaagaagatccaggaggagatcgagaagaaggagaccctgatccaggagaacgtggtgctgccccagatccacaccgtgaccggcaccaagaacttcatgaagaacctgttcctgctgagcaccagacagaacgtggagggcagctacgacggcgcctacgcccccgtgctgcaggacttcagaagcctgaacgacagcaccaacagaaccaagaagcacaccgcccacttcagcaagaagggcgaggaggagaacctggagggcctgggcaaccagaccaagcagatcgtggagaagtacgcctgcaccaccagaatcagccccaacaccagccagcagaacttcgtgacccagagaagcaagagagccctgaagcagttcagactgcccctggaggagaccgagctggagaagagaatcatcgtggacgacaccagcacccagtggagcaagaacatgaagcacctgacccccagcaccctgacccagatcgactacaacgagaaggagaagggcgccatcacccagagccccctgagcgactgcctgaccagaagccacagcatcccccaggccaacagaagccccctgcccatcgccaaggtgagcagcttccccagcatcagacccatctacctgaccagagtgctgttccaggacaacagcagccacctgcccgccgccagctacagaaagaaggacagcggcgtgcaggagagcagccacttcctgcagggcgccaagaagaacaacctgagcctggccatcctgaccctggagatgaccggcgaccagagagaggtgggcagcctgggcaccagcgccaccaacagcgtgacctacaagaaggtggagaacaccgtgctgcccaagcccgacctgcccaagaccagcggcaaggtggagctgctgcccaaggtgcacatctaccagaaggacctgttccccaccgagaccagcaacggcagccccggccacctggacctggtggagggcagcctgctgcagggcaccgagggcgccatcaagtggaacgaggccaacagacccggcaaggtgcccttcctgagagtggccaccgagagcagcgccaagacccccagcaagctgctggaccccctggcctgggacaaccactacggcacccagatccccaaggaggagtggaagagccaggagaagagccccgagaagaccgccttcaagaagaaggacaccatcctgagcctgaacgcctgcgagagcaaccacgccatcgccgccatcaacgagggccagaacaagcccgagatcgaggtgacctgggccaagcagggcagaaccgagagactgtgcagccagaacccccccgtgctgaagagacaccagagagagatcaccagaaccaccctgcagagcgaccaggaggagatcgactacgacgacaccatcagcgtggagatgaagaaggaggacttcgacatctacgacgaggacgagaaccagagccccagaagcttccagaagaagaccagacactacttcatcgccgccgtggagagactgtgggactacggcatgagcagcagcccccacgtgctgagaaacagagcccagagcggcagcgtgccccagttcaagaaggtggtgttccaggagttcaccgacggcagcttcacccagcccctgtacagaggcgagctgaacgagcacctgggcctgctgggcccctacatcagagccgaggtggaggacaacatcatggtgaccttcagaaaccaggccagcagaccctacagcttctacagcagcctgatcagctacgaggaggaccagagacagggcgccgagcccagaaagaacttcgtgaagcccaacgagaccaagacctacttctggaaggtgcagcaccacatggcccccaccaaggacgagttcgactgcaaggcctgggcctacttcagcgacgtggacctggagaaggacgtgcacagcggcctgatcggccccctgctggtgtgccacaccaacaccctgaaccccgcccacggcagacaggtgaccgtgcaggagttcgccctgttcttcaccatcttcgacgagaccaagagctggtacttcaccgagaacatggagagaaactgcagagccccctgcaacatccagatggaggaccccaccttcaaggagaactacagattccacgccatcaacggctacatcatggacaccctgcccggcctggtgatggcccaggaccagagaatcagatggtacctgctgagcatgggcagcaacgagaacatccacagcatccacttcagcggccacgtgttcaccgtgagaaagaaggaggagtacaagatggccctgtacaacctgtaccccggcgtgttcgagaccgtggagatgctgcccagcaaggccggcatctggagagtggagtgcctgatcggcgagcacctgcacgccggcatgagcaccctgttcctggtgtacagcaacaagtgccagacccccctgggcatggccagcggccacatcagagacttccagatcaccgccagcggccagtacggccagtgggcccccaagctggccagactgcactacagcggcagcatcaacgcctggagcaccaaggagcccttcagctggatcaaggtggacctgctggcccccatgatcatccacggcatcaagacccagggcgccagacagaagttcagcagcctgtacatcagccagttcatcatcatgtacagcctggacggcaagaagtggcagacctacagaggcaacagcaccggcaccctgatggtgttcttcggcaacgtggacagcagcggcatcaagcacaacatcttcaacccccccatcatcgccagatacatcagactgcaccccacccactacagcatcagaagcaccctgagaatggagctgatgggctgcgacctgaacagctgcagcatgcccctgggcatggagagcaaggccatcagcgacgcccagatcaccgccagcagctacttcaccaacatgttcgccacctggagccccagcaaggccagactgcacctgcagggcagaagcaacgcctggagaccccaggtgaacaaccccaaggagtggctgcaggtggacttccagaagaccatgaaggtgaccggcgtgaccacccagggcgtgaagagcctgctgaccagcatgtacgtgaaggagttcctgatcagcagcagccaggacggccaccagtggaccctgttcttccagaacggcaaggtgaaggtgttccagggcaaccaggacagcttcacccccgtggtgaacagcctggacccccccctgctgaccagatacctgagaatccacccccagagctgggtgcaccagatcgccctgagaatggaggtgctgggctgcgaggcccaggacctgtactag

SEQ ID NO: 1812 - DNA, 999 bp, Artificial Sequence
  Description of Artificial Sequence: Synthetic coding sequence
atgggcagacccctgcacctggtgctgctgagcgccagcctggccggcctgctgctgctgggcgagagcctgttcatcagaagagagcaggccaacaacatcctggccagagtgaccagagccaacagcttcctggaggagatgaagaagggccacctggagagagagtgcatggaggagacctgcagctacgaggaggccagagaggtgttcgaggacagcgacaagaccaacgagttctggaacaagtacaaggacggcgaccagtgcgagaccagcccctgccagaaccagggcaagtgcaaggacggcctgggcgagtacacctgcacctgcctggagggcttcgagggcaagaactgcgagctgttcaccagaaagctgtgcagcctggacaacggcgactgcgaccagttctgccacgaggagcagaacagcgtggtgtgcagctgcgccagaggctacaccctggccgacaacggcaaggcctgcatccccaccggcccctacccctgcggcaagcagaccctggagagaagaaagagaagcgtggcccaggccaccagcagcagcggcgaggcccccgacagcatcacctggaagccctacgacgccgccgacctggaccccaccgagaaccccttcgacctgctggacttcaaccagacccagcccgagagaggcgacaacaacctgaccagaatcgtgggcggccaggagtgcaaggacggcgagtgcccctggcaggccctgctgatcaacgaggagaacgagggcttctgcggcggcaccatcctgagcgagttctacatcctgaccgccgcccactgcctgtaccaggccaagagattcaagggcaccggcaccagaagcagaagaagagccgtgagaagatgcaccagatggagatggagcagcagcaccaccggcagccagagaagacccatgaccagcaccagcccctgcagcggcagcagaccccccagccccagcgcctag

SEQ ID NO: 1813 - DNA, 1467 bp, Artificial Sequence
  Description of Artificial Sequence: Synthetic coding sequence
atgggcagacccctgcacctggtgctgctgagcgccagcctggccggcctgctgctgctgggcgagagcctgttcatcagaagagagcaggccaacaacatcctggccagagtgaccagagccaacagcttcctggaggagatgaagaagggccacctggagagagagtgcatggaggagacctgcagctacgaggaggccagagaggtgttcgaggacagcgacaagaccaacgagttctggaacaagtacaaggacggcgaccagtgcgagaccagcccctgccagaaccagggcaagtgcaaggacggcctgggcgagtacacctgcacctgcctggagggcttcgagggcaagaactgcgagctgttcaccagaaagctgtgcagcctggacaacggcgactgcgaccagttctgccacgaggagcagaacagcgtggtgtgcagctgcgccagaggctacaccctggccgacaacggcaaggcctgcatccccaccggcccctacccctgcggcaagcagaccctggagagaagaaagagaagcgtggcccaggccaccagcagcagcggcgaggcccccgacagcatcacctggaagccctacgacgccgccgacctggaccccaccgagaaccccttcgacctgctggacttcaaccagacccagcccgagagaggcgacaacaacctgaccagaatcgtgggcggccaggagtgcaaggacggcgagtgcccctggcaggccctgctgatcaacgaggagaacgagggcttctgcggcggcaccatcctgagcgagttctacatcctgaccgccgcccactgcctgtaccaggccaagagattcaaggtgagagtgggcgacagaaacaccgagcaggaggagggcggcgaggccgtgcacgaggtggaggtggtgatcaagcacaacagattcaccaaggagacctacgacttcgacatcgccgtgctgagactgaagacccccatcaccttcagaatgaacgtggcccccgcctgcctgcccgagagagactgggccgagagcaccctgatgacccagaagaccggcatcgtgagcggcttcggcagaacccacgagaagggcagacagagcaccagactgaagatgctggaggtgccctacgtggacagaaacagctgcaagctgagcagcagcttcatcatcacccagaacatgttctgcgccggctacgacaccaagcaggaggacgcctgccagggcgacagcggcggcccccacgtgaccagattcaaggacacctacttcgtgaccggcatcgtgagctggggcgagggctgcgccagaaagggcaagtacggcatctacaccaaggtgaccgccttcctgaagtggatcgacagaagcatgaagaccagaggcctgcccaaggccaagagccacgcccccgaggtgatcaccagcagccccctgaagtag

SEQ ID NO: 1814 - DNA, 1005 bp, Artificial Sequence
  Description of Artificial Sequence: Synthetic coding sequence
atgggcagacccctgcacctggtgctgctgagcgccagcctggccggcctgctgctgctgggcgagagcctgttcatcagaagagagcaggccaacaacatcctggccagagtgaccagagccaacagcttcctggaggagatgaagaagggccacctggagagagagtgcatggaggagacctgcagctacgaggaggccagagaggtgttcgaggacagcgacaagaccaacgagttctggaacaagtacaaggacggcgaccagtgcgagaccagcccctgccagaaccagggcaagtgcaaggacggcctgggcgagtacacctgcacctgcctggagggcttcgagggcaagaactgcgagctgttcaccagaaagctgtgcagcctggacaacggcgactgcgaccagttctgccacgaggagcagaacagcgtggtgtgcagctgcgccagaggctacaccctggccgacaacggcaaggcctgcatccccaccggcccctacccctgcggcaagcagaccctggagagaagaaagagaagcgtggcccaggccaccagcagcagcggcgaggcccccgacagcatcacctggaagccctacgacgccgccgacctggaccccaccgagaaccccttcgacctgctggacttcaaccagacccagcccgagagaggcgacaacaacctgaccagaatcgtgggcggccaggagtgcaaggacggcgagtgcccctggcaggccctgctgatcaacgaggagaacgagggcttctgcggcggcaccatcctgagcgagttctacatcctgaccgccgcccactgcctgtaccaggccaagagattcaaggtgagaggcaccggcaccagaagcagaagaagagccgtgagaagatgcaccagatggagatggagcagcagcaccaccggcagccagagaagacccatgaccagcaccagcccctgcagcggcagcagaccccccagccccagcgcctag

SEQ ID NO: 1815 - DNA, 1722 bp, Artificial Sequence
  Description of Artificial Sequence: Synthetic coding sequence
atgatcttcctgtaccaggtggtgcacttcatcctgttcaccagcgtgagcggcgagtgcgtgacccagctgctgaaggacacctgcttcgagggcggcgacatcaccaccgtgttcacccccagcgccaagtactgccaggtggtgtgcacctaccaccccagatgcctgctgttcaccttcaccgccgagagccccagcgaggaccccaccagatggttcacctgcgtgctgaaggacagcgtgaccgagaccctgcccagagtgaacagaaccgccgccatcagcggctacagcttcaagcagtgcagccaccagatcagcgtgaacaacatctgcctgctgaagcacacccagaccggcacccccaccagaatcaccaagctggacaaggtggtgagcggcttcagcctgaagagctgcgccctgagcaacctggcctgcatcagagacatcttccccaacaccgtgttcgccgacagcaacatcgacagcgtgatggcccccgacgccttcgtgtgcggcagaatctgcacccaccaccccggctgcctgttcttcaccttcttcagccaggagtggcccaaggagagccagagaaacctgtgcctgctgaagaccagcgagagcggcctgcccagcaccagaatcaagaagagcaaggccctgagcggcttcagcctgcagagctgcagacacagcatccccgtgttctgccacagcagcttctaccacgacaccgacttcctgggcgaggagctggacatcgtggccgccaagagccacgaggcctgccagaagctgtgcaccaacgccgtgagatgccagttcttcacctacacccccgcccaggccagctgcaacgagggcaagggcaagtgctacctgaagctgagcagcaacggcagccccaccaagatcctgcacggcagaggcggcatcagcggctacaccctgagactgtgcaagatggacaacgagtgcaccaccaagatcaagcccagaatcgtgggcggcaccgccagcgtgagaggcgagtggccctggcaggtgaccctgcacaccaccagccccacccagagacacctgtgcggcggcagcatcatcggcaaccagtggatcctgaccgccgcccactgcttctacggcgtggagagccccaagatcctgagagtgtacagcggcatcctgaaccagagcgagatcaaggaggacaccagcttcttcggcgtgcaggagatcatcatccacgaccagtacaagatggccgagagcggctacgacatcgccctgctgaagctggagaccaccgtgaactacaccgacagccagagacccatctgcctgcccagcaagggcgacagaaacgtgatctacaccgactgctgggtgaccggctggggctacagaaagctgagagacaagatccagaacaccctgcagaaggccaagatccccctggtgaccaacgaggagtgccagaagagatacagaggccacaagatcacccacaagatgatctgcgccggctacagagagggcggcaaggacgcctgcaagggcgacagcggcggccccctgagctgcaagcacaacgaggtgtggcacctggtgggcatcaccagctggggcgagggctgcgcccagagagagagacccggcgtgtacaccaacgtggtggagtacgtggactggatcctggagaagacccaggccgtgtag

SEQ ID NO: 1816 - DNA, 1878 bp, Artificial Sequence
  Description of Artificial Sequence: Synthetic coding sequence
atgatcttcctgtaccaggtggtgcacttcatcctgttcaccagcgtgagcggcgagtgcgtgacccagctgctgaaggacacctgcttcgagggcggcgacatcaccaccgtgttcacccccagcgccaagtactgccaggtggtgtgcacctaccaccccagatgcctgctgttcaccttcaccgccgagagccccagcgaggaccccaccagatggttcacctgcgtgctgaaggacagcgtgaccgagaccctgcccagagtgaacagaaccgccgccatcagcggctacagcttcaagcagtgcagccaccagatcagcgcctgcaacaaggacatctacgtggacctggacatgaagggcatcaactacaacagcagcgtggccaagagcgcccaggagtgccaggagagatgcaccgacgacgtgcactgccacttcttcacctacgccaccagacagttccccagcctggagcacagaaacatctgcctgctgaagcacacccagaccggcacccccaccagaatcaccaagctggacaaggtggtgagcggcttcagcctgaagagctgcgccctgagcaacctggcctgcatcagagacatcttccccaacaccgtgttcgccgacagcaacatcgacagcgtgatggcccccgacgccttcgtgtgcggcagaatctgcacccaccaccccggctgcctgttcttcaccttcttcagccaggagtggcccaaggagagccagagaaacctgtgcctgctgaagaccagcgagagcggcctgcccagcaccagaatcaagaagagcaaggccctgagcggcttcagcctgcagagctgcagacacagcatccccgtgttctgccacagcagcttctaccacgacaccgacttcctgggcgaggagctggacatcgtggccgccaagagccacgaggcctgccagaagctgtgcaccaacgccgtgagatgccagttcttcacctacacccccgcccaggccagctgcaacgagggcaagggcaagtgctacctgaagctgagcagcaacggcagccccaccaagatcctgcacggcagaggcggcatcagcggctacaccctgagactgtgcaagatggacaacgagtgcaccaccaagatcaagcccagaatcgtgggcggcaccgccagcgtgagaggcgagtggccctggcaggtgaccctgcacaccaccagccccacccagagacacctgtgcggcggcagcatcatcggcaaccagtggatcctgaccgccgcccactgcttctacggcgtggagagccccaagatcctgagagtgtacagcggcatcctgaaccagagcgagatcaaggaggacaccagcttcttcggcgtgcaggagatcatcatccacgaccagtacaagatggccgagagcggctacgacatcgccctgctgaagctggagaccaccgtgaactacaccgacagccagagacccatctgcctgcccagcaagggcgacagaaacgtgatctacaccgactgctgggtgaccggctggggctacagaaagctgagagacaagatccagaacaccctgcagaaggccaagatccccctggtgaccaacgaggagtgccagaagagatacagaggccacaagatcacccacaagatgatctgcgccggctacagagagggcggcaaggacgcctgcaagggcgacagcggcggccccctgagctgcaagcacaacgaggtgtggcacctggtgggcatcaccagctggggcgagggctgcgcccagagagagagacccggcgtgtacaccaacgtggtggagtacgtggactggatcctggagaagacccaggccgtgtag

SEQ ID NO: 1817 - DNA, 633 bp, Artificial Sequence
  Description of Artificial Sequence: Synthetic coding sequence
tgaagcggcttcagcctgaagagctgcgccctgagcaacctggcctgcatcagagacatcttccccaacaccgtgttcgccgacagcaacatcgacagcgtgatggcccccgacgccttcgtgtgcggcagaatctgcacccaccaccccggctgcctgttcttcaccttcttcagccaggagtggcccaaggagagccagagaaacctgtgcctgctgaagaccagcgagagcggcctgcccagcaccagaatcaagaagagcaaggccctgagcggcttcagcctgcagagctgcagacacagcatccccgtgttctgccacagcagcttctaccacgacaccgacttcctgggcgaggagctggacatcgtggccgccaagagccacgaggcctgccagaagctgtgcaccaacgccgtgagatgccagttcttcacctacacccccgcccaggccagctgcaacgagggcaagggcaagtgctacctgaagctgagcagcaacggcagccccaccaagatcctgcacggcagaggcggcatcagcggctacaccctgagactgtgcaagatggacaacgagctgagaggcgcccccatgaagatcagcggctggctgaagaccagctag

SEQ ID NO: 1818 - DNA, 2199 bp, Artificial Sequence
  Description of Artificial Sequence: Synthetic coding sequence
atgagcgagaccagcagaaccgccttcggcggcagaagagccgtgccccccaacaacagcaacgccgccgaggacgacctgcccaccgtggagctgcagggcgtggtgcccagaggcgtgaacctgcaggagttcctgaacgtgaccagcgtgcacctgttcaaggagagatgggacaccaacaaggtggaccaccacaccgacaagtacgagaacaacaagctgatcgtgagaagaggccagagcttctacgtgcagatcgacttcagcagaccctacgaccccagaagagacctgttcagagtggagtacgtgatcggcagatacccccaggagaacaagggcacctacatccccgtgcccatcgtgagcgagctgcagagcggcaagtggggcgccaagatcgtgatgagagaggacagaagcgtgagactgagcatccagagcagccccaagtgcatcgtgggcaagttcagaatgtacgtggccgtgtggaccccctacggcgtgctgagaaccagcagaaaccccgagaccgacacctacatcctgttcaacccctggtgcgaggacgacgccgtgtacctggacaacgagaaggagagagaggagtacgtgctgaacgacatcggcgtgatcttctacggcgaggtgaacgacatcaagaccagaagctggagctacggccagttcgaggacggcatcctggacacctgcctgtacgtgatggacagagcccagatggacctgagcggcagaggcaaccccatcaaggtgagcagagtgggcagcgccatggtgaacgccaaggacgacgagggcgtgctggtgggcagctgggacaacatctacgcctacggcgtgccccccagcgcctggaccggcagcgtggacatcctgctggagtacagaagcagcgagaaccccgtgagatacggccagtgctgggtgttcgccggcgtgttcaacaccttcctgagatgcctgggcatccccgccagaatcgtgaccaactacttcagcgcccacgacaacgacgccaacctgcagatggacatcttcctggaggaggacggcaacgtgaacagcaagctgaccaaggacagcgtgtggaactaccactgctggaacgaggcctggatgaccagacccgacctgcccgtgggcttcggcggctggcaggccgtggacagcaccccccaggagaacagcgacggcatgtacagatgcggccccgccagcgtgcaggccatcaagcacggccacgtgtgcttccagttcgacgcccccttcgtgttcgccgaggtgaacagcgacctgatctacatcaccgccaagaaggacggcacccacgtggtggagaacgtggacgccacccacatcggcaagctgatcgtgaccaagcagatcggcggcgacggcatgatggacatcaccgacacctacaagttccaggagggccaggaggaggagagactggccctggagaccgccctgatgtacggcgccaagaagcccctgaacaccgagggcgtgatgaagagcagaagcaacgtggacatggacttcgaggtggagaacgccgtgctgggcaaggacttcaagctgagcatcaccttcagaaacaacagccacaacagatacaccatcaccgcctacctgagcgccaacatcaccttctacaccggcgtgcccaaggccgagttcaagaaggagaccttcgacgtgaccctggagcccctgagcttcaagaaggaggccgtgctgatccaggccggcgagtacatgggccagctgctggagcaggccagcctgcacttcttcgtgaccgccagaatcaacgagaccagagacgtgctggccaagcagaagagcaccgtgctgaccatccccgagatcatcatcaaggtgagaggcacccaggtggtgggcagcgacatgaccgtgaccgtggagttcaccaaccccctgaaggagaccctgagaaacgtgtgggtgcacctggacggccccggcgtgaccagacccatgaagaagatgttcagagagatcagacccaacagcaccgtgcagtgggaggaggtgtgcagaccctgggtgagcggccacagaaagctgatcgccagcatgagcagcgacagcctgagacacgtgtacggcgagctggacgtgcagatccagagaagacccagcatgtag

SEQ ID NO: 1819 - DNA, 417 bp, Artificial Sequence
  Description of Artificial Sequence: Synthetic coding sequence
atgagcgagaccagcagaaccgccttcggcggcagaagagccgtgccccccaacaacagcaacgccgccgaggacgacctgcccaccgtggagctgcagggcgtggtgcccagaggcgtgaacctgcaggagttcctgaacgtgaccagcgtgcacctgttcaaggagagatgggacaccaacaaggtggaccaccacaccgacaagtacgagaacaacaagctgatcgtgagaagaggccagagcttctacgtgcagatcgacttcagcagaccctacgaccccagaagagacctgttcagagtggagtacgtgatcggcagatacccccaggagaacaagggcacctacatccccgtgcccatcgtgagcgagctgcagagcggcaagtggggcgccaagatcgtgatgagatag

SEQ ID NO: 1820 - DNA, 1881 bp, Artificial Sequence
  Description of Artificial Sequence: Synthetic coding sequence
atgagcgagaccagcagaaccgccttcggcggcagaagagccgtgccccccaacaacagcaacgccgccgaggacgacctgcccaccgtggagctgcagggcgtggtgcccagaggcgtgaacctgcagggcagatacccccaggagaacaagggcacctacatccccgtgcccatcgtgagcgagctgcagagcggcaagtggggcgccaagatcgtgatgagagaggacagaagcgtgagactgagcatccagagcagccccaagtgcatcgtgggcaagttcagaatgtacgtggccgtgtggaccccctacggcgtgctgagaaccagcagaaaccccgagaccgacacctacatcctgttcaacccctggtgcgaggacgacgccgtgtacctggacaacgagaaggagagagaggagtacgtgctgaacgacatcggcgtgatcttctacggcgaggtgaacgacatcaagaccagaagctggagctacggccagttcgaggacggcatcctggacacctgcctgtacgtgatggacagagcccagatggacctgagcggcagaggcaaccccatcaaggtgagcagagtgggcagcgccatggtgaacgccaaggacgacgagggcgtgctggtgggcagctgggacaacatctacgcctacggcgtgccccccagcgcctggaccggcagcgtggacatcctgctggagtacagaagcagcgagaaccccgtgagatacggccagtgctgggtgttcgccggcgtgttcaacaccttcctgagatgcctgggcatccccgccagaatcgtgaccaactacttcagcgcccacgacaacgacgccaacctgcagatggacatcttcctggaggaggacggcaacgtgaacagcaagctgaccaaggacagcgtgtggaactaccactgctggaacgaggcctggatgaccagacccgacctgcccgtgggcttcggcggctggcaggccgtggacagcaccccccaggagaacagcgacggcatgtacagatgcggccccgccagcgtgcaggccatcaagcacggccacgtgtgcttccagttcgacgcccccttcgtgttcgccgaggtgaacagcgacctgatctacatcaccgccaagaaggacggcacccacgtggtggagaacgtggacgccacccacatcggcaagctgatcgtgaccaagcagatcggcggcgacggcatgatggacatcaccgacacctacaagttccaggagggccaggaggaggagagactggccctggagaccgccctgatgtacggcgccaagaagcccctgaacaccgagggcgtgatgaagagcagaagcaacgtggacatggacttcgaggtggagaacgccgtgctgggcaaggacttcaagctgagcatcaccttcagaaacaacagccacaacagatacaccatcaccgcctacctgagcgccaacatcaccttctacaccggcgtgcccaaggccgagttcaagaaggagaccttcgacgtgaccctggagcccctgagcttcaagaaggaggccgtgctgatccaggccggcgagtacatgggccagctgctggagcaggccagcctgcacttcttcgtgaccgccagaatcaacgagaccagagacgtgctggccaagcagaagagcaccgtgctgaccatccccgagatcatcatcaaggtgagaggcacccaggtggtgggcagcgacatgaccgtgaccgaggtgtgcagaccctgggtgagcggccacagaaagctgatcgccagcatgagcagcgacagcctgagacacgtgtacggcgagctggacgtgcagatccagagaagacccagcatgtag

SEQ ID NO: 1821 - DNA, 8835 bp, Artificial Sequence
  Description of Artificial Sequence: Synthetic coding sequence
atgaccctgagactgctggtggccgccctgtgcgccggcatcctggccgaggcccccagagtgagagcccagcacagagagagagtgacctgcaccagactgtacgccgccgacatcgtgttcctgctggacggcagcagcagcatcggcagaagcaacttcagagaggtgagaagcttcctggagggcctggtgctgcccttcagcggcgccgccagcgcccagggcgtgagattcgccaccgtgcagtacagcgacgaccccagaaccgagttcggcctggacgccctgggcagcggcggcgacgtgatcagagccatcagagagctgagctacaagggcggcaacaccagaaccggcgccgccatcctgcacgtggccgaccacgtgttcctgccccagctggccagacccggcgtgcccaaggtgtgcatcctgatcaccgacggcaagagccaggacctggtggacaccgccgcccagagactgaagggccagggcgtgaagctgttcgccgtgggcatcaagaacgccgaccccgaggagctgaagagagtggccagccagcccaccagcgacttcttcttcttcgtgaacgacttcagcatcctgagaaccctgctgcccctggtgagcagaagagtgtgcaccaccgccggcggcgtgcccgtgaccagaccccccgacgacagcaccagcgcccccagagacctggtgctgagcgagcccagcagccagagcctgagagtgcagtggaccgccgccagcggccccgtgaccggctacaaggtgcagtacacccccctgaccggcctgggccagcccctgcccagcgagagacaggaggtgaacgtgcccgccggcgagaccagcgtgagactgagaggcctgagacccctgaccgagtaccaggtgaccgtgatcgccctgtacgccaacagcatcggcgaggccgtgagcggcaccgccagaaccaccgccctggagggccccgagctgaccatccagaacaccaccgcccacagcctgctggtggcctggagaagcgtgcccggcgccaccggctacagagtgacctggagagtgctgagcggcggccccacccagcagcaggagctgggccccggccagggcagcgtgctgctgagagacctggagcccggcaccgactacgaggtgaccgtgagcaccctgttcggcagaagcgtgggccccgccaccagcctgatggccagaaccgacgccagcgtggagcagaccctgagacccgtgatcctgggccccaccagcatcctgctgagctggaacctggtgcccgaggccagaggctacagactggagtggagaagagagaccggcctggagcccccccagaaggtggtgctgcccagcgacgtgaccagataccagctggacggcctgcagcccggcaccgagtacagactgaccctgtacaccctgctggagggccacgaggtggccacccccgccaccgtggtgcccaccggccccgagctgcccgtgagccccgtgaccgacctgcaggccaccgagctgcccggccagagagtgagagtgagctggagccccgtgcccggcgccacccagtacagaatcatcgtgagaagcacccagggcgtggagagaaccctggtgctgcccggcagccagaccgccttcgacctggacgacgtgcaggccggcctgagctacaccgtgagagtgagcgccagagtgggccccagagagggcagcgccagcgtgctgaccgtgagaagagagcccgagacccccctggccgtgcccggcctgagagtggtggtgagcgacgccaccagagtgagagtggcctggggccccgtgcccggcgccagcggcttcagaatcagctggagcaccggcagcggccccgagagcagccagaccctgccccccgacagcaccgccaccgacatcaccggcctgcagcccggcaccacctaccaggtggccgtgagcgtgctgagaggcagagaggagggccccgccgccgtgatcgtggccagaaccgaccccctgggccccgtgagaaccgtgcacgtgacccaggccagcagcagcagcgtgaccatcacctggaccagagtgcccggcgccaccggctacagagtgagctggcacagcgcccacggccccgagaagagccagctggtgagcggcgaggccaccgtggccgagctggacggcctggagcccgacaccgagtacaccgtgcacgtgagagcccacgtggccggcgtggacggcccccccgccagcgtggtggtgagaaccgcccccgagcccgtgggcagagtgagcagactgcagatcctgaacgccagcagcgacgtgctgagaatcacctgggtgggcgtgaccggcgccaccgcctacagactggcctggggcagaagcgagggcggccccatgagacaccagatcctgcccggcaacaccgacagcgccgagatcagaggcctggagggcggcgtgagctacagcgtgagagtgaccgccctggtgggcgacagagagggcacccccgtgagcatcgtggtgaccaccccccccgaggccccccccgccctgggcaccctgcacgtggtgcagagaggcgagcacagcctgagactgagatgggagcccgtgcccagagcccagggcttcctgctgcactggcagcccgagggcggccaggagcagagcagagtgctgggccccgagctgagcagctaccacctggacggcctggagcccgccacccagtacagagtgagactgagcgtgctgggccccgccggcgagggccccagcgccgaggtgaccgccagaaccgagagccccagagtgcccagcatcgagctgagagtggtggacaccagcatcgacagcgtgaccctggcctggacccccgtgagcagagccagcagctacatcctgagctggagacccctgagaggccccggccaggaggtgcccggcagcccccagaccctgcccggcatcagcagcagccagagagtgaccggcctggagcccggcgtgagctacatcttcagcctgacccccgtgctggacggcgtgagaggccccgaggccagcgtgacccagacccccgtgtgccccagaggcctggccgacgtggtgttcctgccccacgccacccaggacaacgcccacagagccgaggccaccagaagagtgctggagagactggtgctggccctgggccccctgggcccccaggccgtgcaggtgggcctgctgagctacagccacagacccagccccctgttccccctgaacggcagccacgacctgggcatcatcctgcagagaatcagagacatgccctacatggaccccagcggcaacaacctgggcaccgccgtggtgaccgcccacagatacatgctggcccccgacgcccccggcagaagacagcacgtgcccggcgtgatggtgctgctggtggacgagcccctgagaggcgacatcttcagccccatcagagaggcccaggccagcggcctgaacgtggtgatgctgggcatggccggcgccgaccccgagcagctgagaagactggcccccggcatggacagcgtgcagaccttcttcgccgtggacgacggccccagcctggaccaggccgtgagcggcctggccaccgccctgtgccaggccagcttcaccacccagcccagacccgagccctgccccgtgtactgccccaagggccagaagggcgagcccggcgagatgggcctgagaggccaggtgggcccccccggcgaccccggcctgcccggcagaaccggcgcccccggcccccagggcccccccggcagcgccaccgccaagggcgagagaggcttccccggcgccgacggcagacccggcagccccggcagagccggcaaccccggcacccccggcgcccccggcctgaagggcagccccggcctgcccggccccagaggcgaccccggcgagagaggccccagaggccccaagggcgagcccggcgcccccggccaggtgatcggcggcgagggccccggcctgcccggcagaaagggcgaccccggccccagcggcccccccggccccagaggccccctgggcgaccccggccccagaggcccccccggcctgcccggcaccgccatgaagggcgacaagggcgacagaggcgagagaggcccccccggccccggcgagggcggcatcgcccccggcgagcccggcctgcccggcctgcccggcagccccggcccccagggccccgtgggcccccccggcaagaagggcgagaagggcgacagcgaggacggcgcccccggcctgcccggccagcccggcagccccggcgagcagggccccagaggcccccccggcgccatcggccccaagggcgacagaggcttccccggccccctgggcgaggccggcgagaagggcgagagaggcccccccggccccgccggcagcagaggcctgcccggcgtggccggcagacccggcgccaagggccccgagggcccccccggccccaccggcagacagggcgagaagggcgagcccggcagacccggcgaccccgccgtggtgggccccgccgtggccggccccaagggcgagaagggcgacgtgggccccgccggccccagaggcgccaccggcgtgcagggcgagagaggcccccccggcctggtgctgcccggcgaccccggccccaagggcgaccccggcgacagaggccccatcggcctgaccggcagagccggcccccccggcgacagcggcccccccggcgagaagggcgaccccggcagacccggcccccccggccccgtgggccccagaggcagagacggcgaggtgggcgagaagggcgacgagggcccccccggcgaccccggcctgcccggcaaggccggcgagagaggcctgagaggcgcccccggcgtgagaggccccgtgggcgagaagggcgaccagggcgaccccggcgaggacggcagaaacggcagccccggcagcagcggccccaagggcgacagaggcgagcccggcccccccggcccccccggcagactggtggacaccggccccggcgccagagagaagggcgagcccggcgacagaggccaggagggccccagaggccccaagggcgaccccggcctgcccggcgcccccggcgagagaggcatcgagggcttcagaggcccccccggcccccagggcgaccccggcgtgagaggccccgccggcgagaagggcgacagaggcccccccggcctggacggcagaagcggcctggacggcaagcccggcgccgccggccccagcggccccaacggcgccgccggcaaggccggcgaccccggcagagacggcctgcccggcctgagaggcgagcagggcctgcccggccccagcggcccccccggcctgcccggcaagcccggcgaggacggcaagcccggcctgaacggcaagaacggcgagcccggcgaccccggcgaggacggcagaaagggcgagaagggcgacagcggcgccagcggcagagagggcagagacggccccaagggcgagagaggcgcccccggcatcctgggcccccagggcccccccggcctgcccggccccgtgggcccccccggccagggcttccccggcgtgcccggcggcaccggccccaagggcgacagaggcgagaccggcagcaagggcgagcagggcctgcccggcgagagaggcctgagaggcgagcccggcagcgtgcccaacgtggacagactgctggagaccgccggcatcaaggccagcgccctgagagagatcgtggagacctgggacgagagcagcggcagcttcctgcccgtgcccgagagaagaagaggccccaagggcgacagcggcgagcagggcccccccggcaaggagggccccatcggcttccccggcgagagaggcctgaagggcgacagaggcgaccccggcccccagggcccccccggcctggccctgggcgagagaggcccccccggccccagcggcctggccggcgagcccggcaagcccggcatccccggcctgcccggcagagccggcggcgtgggcgaggccggcagacccggcgagagaggcgagagaggcgagaagggcgagagaggcgagcagggcagagacggcccccccggcctgcccggcacccccggcccccccggcccccccggccccaaggtgagcgtggacgagcccggccccggcctgagcggcgagcagggcccccccggcctgaagggcgccaagggcgagcccggcagcaacggcgaccagggccccaagggcgacagaggcgtgcccggcatcaagggcgacagaggcgagcccggccccagaggccaggacggcaaccccggcctgcccggcgagagaggcatggccggccccgagggcaagcccggcctgcagggccccagaggcccccccggccccgtgggcggccacggcgaccccggcccccccggcgcccccggcctggccggccccgccggcccccagggccccagcggcctgaagggcgagcccggcgagaccggcccccccggcagaggcctgaccggccccaccggcgccgtgggcctgcccggcccccccggccccagcggcctggtgggcccccagggcagccccggcctgcccggccaggtgggcgagaccggcaagcccggcgcccccggcagagacggcgccagcggcaaggacggcgacagaggcagccccggcgtgcccggcagccccggcctgcccggccccgtgggccccaagggcgagcccggccccaccggcgcccccggccaggccgtggtgggcctgcccggcgccaagggcgagaagggcgcccccggcggcctggccggcgacctggtgggcgagcccggcgccaagggcgacagaggcctgcccggccccagaggcgagaagggcgaggccggcagagccggcgagcccggcgaccccggcgaggacggccagaagggcgcccccggccccaagggcttcaagggcgaccccggcgtgggcgtgcccggcagccccggcccccccggcccccccggcgtgaagggcgacctgggcctgcccggcctgcccggcgcccccggcgtggtgggcttccccggccagaccggccccagaggcgagatgggccagcccggccccagcggcgagagaggcctggccggcccccccggcagagagggcatccccggccccctgggcccccccggcccccccggcagcgtgggcccccccggcgccagcggcctgaagggcgacaagggcgaccccggcgtgggcctgcccggccccagaggcgagagaggcgagcccggcatcagaggcgaggacggcagacccggccaggagggccccagaggcctgaccggcccccccggcagcagaggcgagagaggcgagaagggcgacgtgggcagcgccggcctgaagggcgacaagggcgacagcgccgtgatcctgggcccccccggccccagaggcgccaagggcgacatgggcgagagaggccccagaggcctggacggcgacaagggccccagaggcgacaacggcgaccccggcgacaagggcagcaagggcgagcccggcgacaagggcagcgccggcctgcccggcctgagaggcctgctgggcccccagggccagcccggcgccgccggcatccccggcgaccccggcagccccggcaaggacggcgtgcccggcatcagaggcgagaagggcgacgtgggcttcatgggccccagaggcctgaagggcgagagaggcgtgaagggcgcctgcggcctggacggcgagaagggcgacaagggcgaggccggcccccccggcagacccggcctggccggccacaagggcgagatgggcgagcccggcgtgcccggccagagcggcgcccccggcaaggagggcctgatcggccccaagggcgacagaggcttcgacggccagcccggccccaagggcgaccagggcgagaagggcgagagaggcacccccggcatcggcggcttccccggccccagcggcaacgacggcagcgccggcccccccggcccccccggcagcgtgggccccagaggccccgagggcctgcagggccagaagggcgagagaggcccccccggcgagagagtggtgggcgcccccggcgtgcccggcgcccccggcgagagaggcgagcagggcagacccggccccgccggccccagaggcgagaagggcgaggccgccctgaccgaggacgacatcagaggcttcgtgagacaggagatgagccagcactgcgcctgccagggccagttcatcgccagcggcagcagacccctgcccagctacgccgccgacaccgccggcagccagctgcacgccgtgcccgtgctgagagtgagccacgccgaggaggaggagagagtgccccccgaggacgacgagtacagcgagtacagcgagtacagcgtggaggagtaccaggaccccgaggccccctgggacagcgacgacccctgcagcctgcccctggacgagggcagctgcaccgcctacaccctgagatggtaccacagagccgtgaccggcagcaccgaggcctgccaccccttcgtgtacggcggctgcggcggcaacgccaacagattcggcaccagagaggcctgcgagagaagatgcccccccagagtggtgcagagccagggcaccggcaccgcccaggactag

SEQ ID NO: 1822 - DNA, 8739 bp, Artificial Sequence
  Description of Artificial Sequence: Synthetic coding sequence
atgaccctgagactgctggtggccgccctgtgcgccggcatcctggccgaggcccccagagtgagagcccagcacagagagagagtgacctgcaccagactgtacgccgccgacatcgtgttcctgctggacggcagcagcagcatcggcagaagcaacttcagagaggtgagaagcttcctggagggcctggtgctgcccttcagcggcgccgccagcgcccagggcgtgagattcgccaccgtgcagtacagcgacgaccccagaaccgagttcggcctggacgccctgggcagcggcggcgacgtgatcagagccatcagagagctgagctacaagggcggcaacaccagaaccggcgccgccatcctgcacgtggccgaccacgtgttcctgccccagctggccagacccggcgtgcccaaggtgtgcatcctgatcaccgacggcaagagccaggacctggtggacaccgccgcccagagactgaagggccagggcgtgaagctgttcgccgtgggcatcaagaacgccgaccccgaggagctgaagagagtggccagccagcccaccagcgacttcttcttcttcgtgaacgacttcagcatcctgagaaccctgctgcccctggtgagcagaagagtgtgcaccaccgccggcggcgtgcccgtgaccagaccccccgacgacagcaccagcgcccccagagacctggtgctgagcgagcccagcagccagagcctgagagtgcagtggaccgccgccagcggccccgtgaccggctacaaggtgcagtacacccccctgaccggcctgggccagcccctgcccagcgagagacaggaggtgaacgtgcccgccggcgagaccagcgtgagactgagaggcctgagacccctgaccgagtaccaggtgaccgtgatcgccctgtacgccaacagcatcggcgaggccgtgagcggcaccgccagaaccaccgccctggagggccccgagctgaccatccagaacaccaccgcccacagcctgctggtggcctggagaagcgtgcccggcgccaccggctacagagtgacctggagagtgctgagcggcggccccacccagcagcaggagctgggccccggccagggcagcgtgctgctgagagacctggagcccggcaccgactacgaggtgaccgtgagcaccctgttcggcagaagcgtgggccccgccaccagcctgatggccagaaccgacgccagcgtggagcagaccctgagacccgtgatcctgggccccaccagcatcctgctgagctggaacctggtgcccgaggccagaggctacagactggagtggagaagagagaccggcctggagcccccccagaaggtggtgctgcccagcgacgtgaccagataccagctggacggcctgcagcccggcaccgagtacagactgaccctgtacaccctgctggagggccacgaggtggccacccccgccaccgtggtgcccaccggccccgagctgcccgtgagccccgtgaccgacctgcaggccaccgagctgcccggccagagagtgagagtgagctggagccccgtgcccggcgccacccagtacagaatcatcgtgagaagcacccagggcgtggagagaaccctggtgctgcccggcagccagaccgccttcgacctggacgacgtgcaggccggcctgagctacaccgtgagagtgagcgccagagtgggccccagagagggcagcgccagcgtgctgaccgtgagaagagagcccgagacccccctggccgtgcccggcctgagagtggtggtgagcgacgccaccagagtgagagtggcctggggccccgtgcccggcgccagcggcttcagaatcagctggagcaccggcagcggccccgagagcagccagaccctgccccccgacagcaccgccaccgacatcaccggcctgcagcccggcaccacctaccaggtggccgtgagcgtgctgagaggcagagaggagggccccgccgccgtgatcgtggccagaaccgaccccctgggccccgtgagaaccgtgcacgtgacccaggccagcagcagcagcgtgaccatcacctggaccagagtgcccggcgccaccggctacagagtgagctggcacagcgcccacggccccgagaagagccagctggtgagcggcgaggccaccgtggccgagctggacggcctggagcccgacaccgagtacaccgtgcacgtgagagcccacgtggccggcgtggacggcccccccgccagcgtggtggtgagaaccgcccccgagcccgtgggcagagtgagcagactgcagatcctgaacgccagcagcgacgtgctgagaatcacctgggtgggcgtgaccggcgccaccgcctacagactggcctggggcagaagcgagggcggccccatgagacaccagatcctgcccggcaacaccgacagcgccgagatcagaggcctggagggcggcgtgagctacagcgtgagagtgaccgccctggtgggcgacagagagggcacccccgtgagcatcgtggtgaccaccccccccgaggccccccccgccctgggcaccctgcacgtggtgcagagaggcgagcacagcctgagactgagatgggagcccgtgcccagagcccagggcttcctgctgcactggcagcccgagggcggccaggagcagagcagagtgctgggccccgagctgagcagctaccacctggacggcctggagcccgccacccagtacagagtgagactgagcgtgctgggccccgccggcgagggccccagcgccgaggtgaccgccagaaccgagagccccagagtgcccagcatcgagctgagagtggtggacaccagcatcgacagcgtgaccctggcctggacccccgtgagcagagccagcagctacatcctgagctggagacccctgagaggccccggccaggaggtgcccggcagcccccagaccctgcccggcatcagcagcagccagagagtgaccggcctggagcccggcgtgagctacatcttcagcctgacccccgtgctggacggcgtgagaggccccgaggccagcgtgacccagacccccgtgtgccccagaggcctggccgacgtggtgttcctgccccacgccacccaggacaacgcccacagagccgaggccaccagaagagtgctggagagactggtgctggccctgggccccctgggcccccaggccgtgcaggtgggcctgctgagctacagccacagacccagccccctgttccccctgaacggcagccacgacctgggcatcatcctgcagagaatcagagacatgccctacatggaccccagcggcaacaacctgggcaccgccgtggtgaccgcccacagatacatgctggcccccgacgcccccggcagaagacagcacgtgcccggcgtgatggtgctgctggtggacgagcccctgagaggcgacatcttcagccccatcagagaggcccaggccagcggcctgaacgtggtgatgctgggcatggccggcgccgaccccgagcagctgagaagactggcccccggcatggacagcgtgcagaccttcttcgccgtggacgacggccccagcctggaccaggccgtgagcggcctggccaccgccctgtgccaggccagcttcaccacccagcccagacccgagccctgccccgtgtactgccccaagggccagaagggcgagcccggcgagatgggcctgagaggccaggtgggcccccccggcgaccccggcctgcccggcagaaccggcgcccccggcccccagggcccccccggcagcgccaccgccaagggcgagagaggcttccccggcgccgacggcagacccggcagccccggcagagccggcaaccccggcacccccggcgcccccggcctgaagggcagccccggcctgcccggccccagaggcgaccccggcgagagaggccccagaggccccaagggcgagcccggcgcccccggccaggtgatcggcggcgagggccccggcctgcccggcagaaagggcgaccccggccccagcggcccccccggccccagaggccccctgggcgaccccggccccagaggcccccccggcctgcccggcaccgccatgaagggcgacaagggcgacagaggcgagagaggcccccccggccccggcgagggcggcatcgcccccggcgagcccggcctgcccggcctgcccggcagccccggcccccagggccccgtgggcccccccggcaagaagggcgagaagggcgacagcgaggacggcgcccccggcctgcccggccagcccggcagccccggcgagcagggccccagaggcccccccggcgccatcggccccaagggcgacagaggcttccccggccccctgggcgaggccggcgagaagggcgagagaggcccccccggccccgccggcagcagaggcctgcccggcgtggccggcagacccggcgccaagggccccgagggcccccccggccccaccggcagacagggcgagaagggcgagcccggcagacccggcgaccccgccgtggtgggccccgccgtggccggccccaagggcgagaagggcgacgtgggccccgccggccccagaggcgccaccggcgtgcagggcgagagaggcccccccggcctggtgctgcccggcgaccccggccccaagggcgaccccggcgacagaggccccatcggcctgaccggcagagccggcccccccggcgacagcggcccccccggcgagaagggcgaccccggcagacccggcccccccggccccgtgggccccagaggcagagacggcgaggtgggcgagaagggcgacgagggcccccccggcgaccccggcctgcccggcaaggccggcgagagaggcctgagaggcgcccccggcgtgagaggccccgtgggcgagaagggcgaccagggcgaccccggcgaggacggcagaaacggcagccccggcagcagcggccccaagggcgacagaggcgagcccggcccccccggcccccccggcagactggtggacaccggccccggcgccagagagaagggcgagcccggcgacagaggccaggagggccccagaggccccaagggcgaccccggcctgcccggcgcccccggcgagagaggcatcgagggcttcagaggcccccccggcccccagggcgaccccggcgtgagaggccccgccggcgagaagggcgacagaggcccccccggcctggacggcagaagcggcctggacggcaagcccggcgccgccggccccagcggccccaacggcgccgccggcaaggccggcgaccccggcagagacggcctgcccggcctgagaggcgagcagggcctgcccggccccagcggcccccccggcctgcccggcaagcccggcgaggacggcaagcccggcctgaacggcaagaacggcgagcccggcgaccccggcgaggacggcagaaagggcgagaagggcgacagcggcgccagcggcagagagggcttccccggcgtgcccggcggcaccggccccaagggcgacagaggcgagaccggcagcaagggcgagcagggcctgcccggcgagagaggcctgagaggcgagcccggcagcgtgcccaacgtggacagactgctggagaccgccggcatcaaggccagcgccctgagagagatcgtggagacctgggacgagagcagcggcagcttcctgcccgtgcccgagagaagaagaggccccaagggcgacagcggcgagcagggcccccccggcaaggagggccccatcggcttccccggcgagagaggcctgaagggcgacagaggcgaccccggcccccagggcccccccggcctggccctgggcgagagaggcccccccggccccagcggcctggccggcgagcccggcaagcccggcatccccggcctgcccggcagagccggcggcgtgggcgaggccggcagacccggcgagagaggcgagagaggcgagaagggcgagagaggcgagcagggcagagacggcccccccggcctgcccggcacccccggcccccccggcccccccggccccaaggtgagcgtggacgagcccggccccggcctgagcggcgagcagggcccccccggcctgaagggcgccaagggcgagcccggcagcaacggcgaccagggccccaagggcgacagaggcgtgcccggcatcaagggcgacagaggcgagcccggccccagaggccaggacggcaaccccggcctgcccggcgagagaggcatggccggccccgagggcaagcccggcctgcagggccccagaggcccccccggccccgtgggcggccacggcgaccccggcccccccggcgcccccggcctggccggccccgccggcccccagggccccagcggcctgaagggcgagcccggcgagaccggcccccccggcagaggcctgaccggccccaccggcgccgtgggcctgcccggcccccccggccccagcggcctggtgggcccccagggcagccccggcctgcccggccaggtgggcgagaccggcaagcccggcgcccccggcagagacggcgccagcggcaaggacggcgacagaggcagccccggcgtgcccggcagccccggcctgcccggccccgtgggccccaagggcgagcccggccccaccggcgcccccggccaggccgtggtgggcctgcccggcgccaagggcgagaagggcgcccccggcggcctggccggcgacctggtgggcgagcccggcgccaagggcgacagaggcctgcccggccccagaggcgagaagggcgaggccggcagagccggcgagcccggcgaccccggcgaggacggccagaagggcgcccccggccccaagggcttcaagggcgaccccggcgtgggcgtgcccggcagccccggcccccccggcccccccggcgtgaagggcgacctgggcctgcccggcctgcccggcgcccccggcgtggtgggcttccccggccagaccggccccagaggcgagatgggccagcccggccccagcggcgagagaggcctggccggcccccccggcagagagggcatccccggccccctgggcccccccggcccccccggcagcgtgggcccccccggcgccagcggcctgaagggcgacaagggcgaccccggcgtgggcctgcccggccccagaggcgagagaggcgagcccggcatcagaggcgaggacggcagacccggccaggagggccccagaggcctgaccggcccccccggcagcagaggcgagagaggcgagaagggcgacgtgggcagcgccggcctgaagggcgacaagggcgacagcgccgtgatcctgggcccccccggccccagaggcgccaagggcgacatgggcgagagaggccccagaggcctggacggcgacaagggccccagaggcgacaacggcgaccccggcgacaagggcagcaagggcgagcccggcgacaagggcagcgccggcctgcccggcctgagaggcctgctgggcccccagggccagcccggcgccgccggcatccccggcgaccccggcagccccggcaaggacggcgtgcccggcatcagaggcgagaagggcgacgtgggcttcatgggccccagaggcctgaagggcgagagaggcgtgaagggcgcctgcggcctggacggcgagaagggcgacaagggcgaggccggcccccccggcagacccggcctggccggccacaagggcgagatgggcgagcccggcgtgcccggccagagcggcgcccccggcaaggagggcctgatcggccccaagggcgacagaggcttcgacggccagcccggccccaagggcgaccagggcgagaagggcgagagaggcacccccggcatcggcggcttccccggccccagcggcaacgacggcagcgccggcccccccggcccccccggcagcgtgggccccagaggccccgagggcctgcagggccagaagggcgagagaggcccccccggcgagagagtggtgggcgcccccggcgtgcccggcgcccccggcgagagaggcgagcagggcagacccggccccgccggccccagaggcgagaagggcgaggccgccctgaccgaggacgacatcagaggcttcgtgagacaggagatgagccagcactgcgcctgccagggccagttcatcgccagcggcagcagacccctgcccagctacgccgccgacaccgccggcagccagctgcacgccgtgcccgtgctgagagtgagccacgccgaggaggaggagagagtgccccccgaggacgacgagtacagcgagtacagcgagtacagcgtggaggagtaccaggaccccgaggccccctgggacagcgacgacccctgcagcctgcccctggacgagggcagctgcaccgcctacaccctgagatggtaccacagagccgtgaccggcagcaccgaggcctgccaccccttcgtgtacggcggctgcggcggcaacgccaacagattcggcaccagagaggcctgcgagagaagatgcccccccagagtggtgcagagccagggcaccggcaccgcccaggactag

SEQ ID NO: 1823 - DNA, 435 bp, Artificial Sequence
  Description of Artificial Sequence: Synthetic coding sequence
atgtggctgcagagcctgctgctgctgggcaccgtggcctgcagcatcagcgcccccgccagaagccccagccccagcacccagccctgggagcacgtgaacgccatccaggaggccagaagactgctgaacctgagcagagacaccgccgccgagatgaacgagaccgtggaggtgatcagcgagatgttcgacctgcaggagcccacctgcctgcagaccagactggagctgtacaagcagggcctgagaggcagcctgaccaagctgaagggccccctgaccatgatggccagccactacaagcagcactgcccccccacccccgagaccagctgcgccacccagatcatcaccttcgagagcttcaaggagaacctgaaggacttcctgctggtgatccccttcgactgctgggagcccgtgcaggagtag

SEQ ID NO: 1824 - DNA, 1218 bp, Artificial Sequence
  Description of Artificial Sequence: Synthetic coding sequence
atggaggccagcttcgtgcagaccaccatggccctgggcctgagcagcaagaaggccagcagcagaaacgtggccgtggagagaaagaacctgatcaccgtgtgcagattcagcgtgaagaccctgctggagaagtacaccgccgagcccatcgacgacagcagcgaggagttcgtgaacttcgccgccatcctggagcagatcctgagccacagattcaaggcctgcgcccccgccggccccgtgagctggttcagcagcgacggccagagaggcttctgggactacatcagactggcctgcagcaaggtgcccaacaactgcgtgagcagcatcgagaacatggagaacatcagcaccgccagagccaagggcagagcctggatcagagtggccctgatggagaagagaatgagcgagtacatcaccaccgccctgagagacaccagaaccaccagaagattctacgacagcggcgccatcatgctgagagacgaggccaccatcctgaccggcatgctgatcggcctgagcgccatcgacttcagcttctgcctgaagggcgaggtgctggacggcaagacccccgtggtgatcgactacaccccctacctgaagttcacccagagctacgactacctgaccgacgaggaggagagacacagcgccgagagcagcaccagcgaggacaacagccccgagcacccctacctgcccctggtgaccgacgaggacagctggtacagcaagtggcacaagatggagcagaagttcagaatcgtgtacgcccagaagggctacctggaggagctggtgagactgagagagagccagctgaaggacctggaggccgagaacagaagactgcagctgcagctggaggaggccgccgcccagaaccagagagagaagagagagctggagggcgtgatcctggagctgcaggagcagctgaccggcctgatccccagcgaccacgcccccctggcccagggcagcaaggagctgaccacccccctggtgaaccagtggcccagcctgggcaccctgaacggcgccgagggcgccagcaacagcaagctgtacagaagacacagcttcatgagcaccgagcccctgagcgccgaggccagcctgagcagcgacagccagagactgggcgagggcaccagagacgaggagccctggggccccatcggcagcagcgagcccaactag

SEQ ID NO: 1825 - DNA, 603 bp, Artificial Sequence
  Description of Artificial Sequence: Synthetic coding sequence
atgagccccgagcccgccctgagccccgccctgcagctgctgctgtggcacagcgccctgtggaccgtgcaggaggccacccccctgggccccgccagcagcctgccccagagcttcctgctgaagtgcctggagcaggtgagaaagatccagggcgacggcgccgccctgcaggagaagctgtgcgccacctacaagctgtgccaccccgaggagctggtgctgctgggccacagcctgggcatcccctgggcccccctgagcagctgccccagccaggccctgcagctggccggctgcctgagccagctgcacagcggcctgttcctgtaccagggcctgctgcaggccctggagggcatcagccccgagctgggccccaccctggacaccctgcagctggacgtggccgacttcgccaccaccatctggcagcagatggaggagctgggcatggcccccgccctgcagcccacccagggcgccatgcccgccttcgccagcgccttccagagaagagccggcggcgtgctggtggccagccacctgcagagcttcctggaggtgagctacagagtgctgagacacctggcccagccctag

SEQ ID NO: 1826 - DNA, 516 bp, Artificial Sequence
  Description of Artificial Sequence: Synthetic coding sequence
atggccggccccgccacccagagccccatgaagctgatggccctgcagctgctgctgtggcacagcgccctgtggaccgtgcaggaggccacccccctgggccccgccagcagcctgccccagagcttcctgctgaagtgcctggagcaggtgagaaagatccagggcgacggcgccgccctgcaggagaagctggtgagcgaggccggctgcctgagccagctgcacagcggcctgttcctgtaccagggcctgctgcaggccctggagggcatcagccccgagctgggccccaccctggacaccctgcagctggacgtggccgacttcgccaccaccatctggcagcagatggaggagctgggcatggcccccgccctgcagcccacccagggcgccatgcccgccttcgccagcgccttccagagaagagccggcggcgtgctggtggccagccacctgcagagcttcctggaggtgagctacagagtgctgagacacctggcccagccctag

SEQ ID NO: 1827 - DNA, 615 bp, Artificial Sequence
  Description of Artificial Sequence: Synthetic coding sequence
atggccggccccgccacccagagccccatgaagctgatggccctgcagctgctgctgtggcacagcgccctgtggaccgtgcaggaggccacccccctgggccccgccagcagcctgccccagagcttcctgctgaagtgcctggagcaggtgagaaagatccagggcgacggcgccgccctgcaggagaagctgtgcgccacctacaagctgtgccaccccgaggagctggtgctgctgggccacagcctgggcatcccctgggcccccctgagcagctgccccagccaggccctgcagctggccggctgcctgagccagctgcacagcggcctgttcctgtaccagggcctgctgcaggccctggagggcatcagccccgagctgggccccaccctggacaccctgcagctggacgtggccgacttcgccaccaccatctggcagcagatggaggagctgggcatggcccccgccctgcagcccacccagggcgccatgcccgccttcgccagcgccttccagagaagagccggcggcgtgctggtggccagccacctgcagagcttcctggaggtgagctacagagtgctgagacacctggcccagccctag

SEQ ID NO: 1828 - DNA, 3696 bp, Artificial Sequence
  Description of Artificial Sequence: Synthetic coding sequence
atgagactgctggccaagatcatctgcctgatgctgtgggccatctgcgtggccgaggactgcaacgagctgccccccagaagaaacaccgagatcctgaccggcagctggagcgaccagacctaccccgagggcacccaggccatctacaagtgcagacccggctacagaagcctgggcaacgtgatcatggtgtgcagaaagggcgagtgggtggccctgaaccccctgagaaagtgccagaagagaccctgcggccaccccggcgacacccccttcggcaccttcaccctgaccggcggcaacgtgttcgagtacggcgtgaaggccgtgtacacctgcaacgagggctaccagctgctgggcgagatcaactacagagagtgcgacaccgacggctggaccaacgacatccccatctgcgaggtggtgaagtgcctgcccgtgaccgcccccgagaacggcaagatcgtgagcagcgccatggagcccgacagagagtaccacttcggccaggccgtgagattcgtgtgcaacagcggctacaagatcgagggcgacgaggagatgcactgcagcgacgacggcttctggagcaaggagaagcccaagtgcgtggagatcagctgcaagagccccgacgtgatcaacggcagccccatcagccagaagatcatctacaaggagaacgagagattccagtacaagtgcaacatgggctacgagtacagcgagagaggcgacgccgtgtgcaccgagagcggctggagacccctgcccagctgcgaggagaagagctgcgacaacccctacatccccaacggcgactacagccccctgagaatcaagcacagaaccggcgacgagatcacctaccagtgcagaaacggcttctaccccgccaccagaggcaacaccgccaagtgcaccagcaccggctggatccccgcccccagatgcaccctgaagccctgcgactaccccgacatcaagcacggcggcctgtaccacgagaacatgagaagaccctacttccccgtggccgtgggcaagtactacagctactactgcgacgagcacttcgagacccccagcggcagctactgggaccacatccactgcacccaggacggctggagccccgccgtgccctgcctgagaaagtgctacttcccctacctggagaacggctacaaccagaaccacggcagaaagttcgtgcagggcaagagcatcgacgtggcctgccaccccggctacgccctgcccaaggcccagaccaccgtgacctgcatggagaacggctggagccccacccccagatgcatcagagtgaagacctgcagcaagagcagcatcgacatcgagaacggcttcatcagcgagagccagtacacctacgccctgaaggagaaggccaagtaccagtgcaagctgggctacgtgaccgccgacggcgagaccagcggcagcatcacctgcggcaaggacggctggagcgcccagcccacctgcatcaagagctgcgacatccccgtgttcatgaacgccagaaccaagaacgacttcacctggttcaagctgaacgacaccctggactacgagtgccacgacggctacgagagcaacaccggcagcaccaccggcagcatcgtgtgcggctacaacggctggagcgacctgcccatctgctacgagagagagtgcgagctgcccaagatcgacgtgcacctggtgcccgacagaaagaaggaccagtacaaggtgggcgaggtgctgaagttcagctgcaagcccggcttcaccatcgtgggccccaacagcgtgcagtgctaccacttcggcctgagccccgacctgcccatctgcaaggagcaggtgcagagctgcggccccccccccgagctgctgaacggcaacgtgaaggagaagaccaaggaggagtacggccacagcgaggtggtggagtactactgcaaccccagattcctgatgaagggccccaacaagatccagtgcgtggacggcgagtggaccaccctgcccgtgtgcatcgtggaggagagcacctgcggcgacatccccgagctggagcacggctgggcccagctgagcagccccccctactactacggcgacagcgtggagttcaactgcagcgagagcttcaccatgatcggccacagaagcatcacctgcatccacggcgtgtggacccagctgccccagtgcgtggccatcgacaagctgaagaagtgcaagagcagcaacctgatcatcctggaggagcacctgaagaacaagaaggagttcgaccacaacagcaacatcagatacagatgcagaggcaaggagggctggatccacaccgtgtgcatcaacggcagatgggaccccgaggtgaactgcagcatggcccagatccagctgtgccccccccccccccagatccccaacagccacaacatgaccaccaccctgaactacagagacggcgagaaggtgagcgtgctgtgccaggagaactacctgatccaggagggcgaggagatcacctgcaaggacggcagatggcagagcatccccctgtgcgtggagaagatcccctgcagccagcccccccagatcgagcacggcaccatcaacagcagcagaagcagccaggagagctacgcccacggcaccaagctgagctacacctgcgagggcggcttcagaatcagcgaggagaacgagaccacctgctacatgggcaagtggagcagccccccccagtgcgagggcctgccctgcaagagcccccccgagatcagccacggcgtggtggcccacatgagcgacagctaccagtacggcgaggaggtgacctacaagtgcttcgagggcttcggcatcgacggccccgccatcgccaagtgcctgggcgagaagtggagccacccccccagctgcatcaagaccgactgcctgagcctgcccagcttcgagaacgccatccccatgggcgagaagaaggacgtgtacaaggccggcgagcaggtgacctacacctgcgccacctactacaagatggacggcgccagcaacgtgacctgcatcaacagcagatggaccggcagacccacctgcagagacaccagctgcgtgaacccccccaccgtgcagaacgcctacatcgtgagcagacagatgagcaagtaccccagcggcgagagagtgagataccagtgcagaagcccctacgagatgttcggcgacgaggaggtgatgtgcctgaacggcaactggaccgagcccccccagtgcaaggacagcaccggcaagtgcggcccccccccccccatcgacaacggcgacatcaccagcttccccctgagcgtgtacgcccccgccagcagcgtggagtaccagtgccagaacctgtaccagctggagggcaacaagagaatcacctgcagaaacggccagtggagcgagccccccaagtgcctgcacccctgcgtgatcagcagagagatcatggagaactacaacatcgccctgagatggaccgccaagcagaagctgtacagcagaaccggcgagagcgtggagttcgtgtgcaagagaggctacagactgagcagcagaagccacaccctgagaaccacctgctgggacggcaagctggagtaccccacctgcgccaagagatag

SEQ ID NO: 1829 - DNA, 1350 bp, Artificial Sequence
  Description of Artificial Sequence: Synthetic coding sequence
atgagactgctggccaagatcatctgcctgatgctgtgggccatctgcgtggccgaggactgcaacgagctgccccccagaagaaacaccgagatcctgaccggcagctggagcgaccagacctaccccgagggcacccaggccatctacaagtgcagacccggctacagaagcctgggcaacgtgatcatggtgtgcagaaagggcgagtgggtggccctgaaccccctgagaaagtgccagaagagaccctgcggccaccccggcgacacccccttcggcaccttcaccctgaccggcggcaacgtgttcgagtacggcgtgaaggccgtgtacacctgcaacgagggctaccagctgctgggcgagatcaactacagagagtgcgacaccgacggctggaccaacgacatccccatctgcgaggtggtgaagtgcctgcccgtgaccgcccccgagaacggcaagatcgtgagcagcgccatggagcccgacagagagtaccacttcggccaggccgtgagattcgtgtgcaacagcggctacaagatcgagggcgacgaggagatgcactgcagcgacgacggcttctggagcaaggagaagcccaagtgcgtggagatcagctgcaagagccccgacgtgatcaacggcagccccatcagccagaagatcatctacaaggagaacgagagattccagtacaagtgcaacatgggctacgagtacagcgagagaggcgacgccgtgtgcaccgagagcggctggagacccctgcccagctgcgaggagaagagctgcgacaacccctacatccccaacggcgactacagccccctgagaatcaagcacagaaccggcgacgagatcacctaccagtgcagaaacggcttctaccccgccaccagaggcaacaccgccaagtgcaccagcaccggctggatccccgcccccagatgcaccctgaagccctgcgactaccccgacatcaagcacggcggcctgtaccacgagaacatgagaagaccctacttccccgtggccgtgggcaagtactacagctactactgcgacgagcacttcgagacccccagcggcagctactgggaccacatccactgcacccaggacggctggagccccgccgtgccctgcctgagaaagtgctacttcccctacctggagaacggctacaaccagaaccacggcagaaagttcgtgcagggcaagagcatcgacgtggcctgccaccccggctacgccctgcccaaggcccagaccaccgtgacctgcatggagaacggctggagccccacccccagatgcatcagagtgatcttccagctgtag

SEQ ID NO: 1830 - DNA, 1350 bp, Artificial Sequence
  Description of Artificial Sequence: Synthetic coding sequence
atgagactgctggccaagatcatctgcctgatgctgtgggccatctgcgtggccgaggactgcaacgagctgccccccagaagaaacaccgagatcctgaccggcagctggagcgaccagacctaccccgagggcacccaggccatctacaagtgcagacccggctacagaagcctgggcaacgtgatcatggtgtgcagaaagggcgagtgggtggccctgaaccccctgagaaagtgccagaagagaccctgcggccaccccggcgacacccccttcggcaccttcaccctgaccggcggcaacgtgttcgagtacggcgtgaaggccgtgtacacctgcaacgagggctaccagctgctgggcgagatcaactacagagagtgcgacaccgacggctggaccaacgacatccccatctgcgaggtggtgaagtgcctgcccgtgaccgcccccgagaacggcaagatcgtgagcagcgccatggagcccgacagagagtaccacttcggccaggccgtgagattcgtgtgcaacagcggctacaagatcgagggcgacgaggagatgcactgcagcgacgacggcttctggagcaaggagaagcccaagtgcgtggagatcagctgcaagagccccgacgtgatcaacggcagccccatcagccagaagatcatctacaaggagaacgagagattccagtacaagtgcaacatgggctacgagtacagcgagagaggcgacgccgtgtgcaccgagagcggctggagacccctgcccagctgcgaggagaagagctgcgacaacccctacatccccaacggcgactacagccccctgagaatcaagcacagaaccggcgacgagatcacctaccagtgcagaaacggcttctaccccgccaccagaggcaacaccgccaagtgcaccagcaccggctggatccccgcccccagatgcaccctgaagccctgcgactaccccgacatcaagcacggcggcctgtaccacgagaacatgagaagaccctacttccccgtggccgtgggcaagtactacagctactactgcgacgagcacttcgagacccccagcggcagctactgggaccacatccactgcacccaggacggctggagccccgccgtgccctgcctgagaaagtgctacttcccctacctggagaacggctacaaccagaaccacggcagaaagttcgtgcagggcaagagcatcgacgtggcctgccaccccggctacgccctgcccaaggcccagaccaccgtgacctgcatggagaacggctggagccccacccccagatgcatcagagtgagcttcaccctgtag

SEQ ID NO: 1831 - DNA, 573 bp, Artificial Sequence
  Description of Artificial Sequence: Synthetic coding sequence
atggccgccggcgagctggagggcggcaagcccctgagcggcctgctgaacgccctggcccaggacaccttccacggctaccccggcatcaccgaggagctgctgagaagccagctgtaccccgaggtgccccccgaggagttcagacccttcctggccaagatgagaggcatcctgaagagcatcgccagcgccgacatggacttcaaccagctggaggccttcctgaccgcccagaccaagaagcagggcggcatcaccagcgaccaggccgccgtgatcagcaagttctggaagagccacaagaccaagatcagagagagcctgatgaaccagagcagatggaacagcggcctgagaggcctgagctggagagtggacggcaagagccagagcagacacagcgcccagatccacacccccgtggccatcatcgagctggagctgggcaagtacggccaggagagcgagttcctgtgcctggagttcgacgaggtgaaggtgaaccagatcctgaagaccctgagcgaggtggaggagagcatcagcaccctgatcagccagcccaactag

SEQ ID NO: 1832 - DNA, 117 bp, Artificial Sequence
  Description of Artificial Sequence: Synthetic coding sequence
tgacaggagagcgagttcctgtgcctggagttcgacgaggtgaaggtgaaccagatcctgaagaccctgagcgaggtggaggagagcatcagcaccctgatcagccagcccaactag

SEQ ID NO: 1833 - DNA, 99 bp, Artificial Sequence
  Description of Artificial Sequence: Synthetic coding sequence
tgatgcctggagttcgacgaggtgaaggtgaaccagatcctgaagaccctgagcgaggtggaggagagcatcagcaccctgatcagccagcccaactag

SEQ ID NO: 1834 - DNA, 117 bp, Artificial Sequence; identical to SEQ ID NO: 1832
  Description of Artificial Sequence: Synthetic coding sequence

SEQ ID NO: 1835 - DNA, 480 bp, Artificial Sequence
  Description of Artificial Sequence: Synthetic coding sequence
atggccgccggcgagctggagggcggcaagcccctgagcggcctgctgaacgccctggcccaggacaccttccacggctaccccggcatcaccgaggagctgctgagaagccagctgtaccccgaggtgccccccgaggagttcagacccttcctggccaagatgagaggcatcctgaagagcatcgccagcgccgacatggacttcaaccagctggaggccttcctgaccgcccagaccaagaagcagggcggcatcaccagcgaccaggccgccgtgatcagcaagttctggaagagccacaagaccaagatcagagagagcctgatgaaccagagcagatggaacagcggcctgagaggcctgagctggagagtggacggcaagagccagagcagacacagcgcccagatccacacccccgtggccatcatcgagctggagctgggcaagtacggccaggtgcactgcaaccagtag

SEQ ID NO: 1836 - DNA, 591 bp, Artificial Sequence
  Description of Artificial Sequence: Synthetic coding sequence
atgagactgcccctgctggtgagcgccggcgtgctgctggtggccctgctgccctgccccccctgcagagccctgctgagcagaggccccgtgcccggcgccagacaggccccccagcacccccagcccctggacttcttccagccccccccccagagcgagcagccccagcagccccaggccagacccgtgctgctgagaatgggcgaggagtacttcctgagactgggcaacctgaacaagagccccgccgcccccctgagccccgccagcagcctgctggccggcggcagcggcagcagacccagccccgagcaggccaccgccaacttcttcagagtgctgctgcagcagctgctgctgcccagaagaagcctggacagccccgccgccctggccgagagaggcgccagaaacgccctgggcggccaccaggaggcccccgagagagagagaagaagcgaggagccccccatcagcctggacctgaccttccacctgctgagagaggtgctggagatggccagagccgagcagctggcccagcaggcccacagcaacagaaagctgatggagatcatcggcaagtag

SEQ ID NO: 1837 - DNA, 4443 bp, Artificial Sequence
  Description of Artificial Sequence: Synthetic coding sequence
atgcagagaagccccctggagaaggccagcgtggtgagcaagctgttcttcagctggaccagacccatcctgagaaagggctacagacagagactggagctgagcgacatctaccagatccccagcgtggacagcgccgacaacctgagcgagaagctggagagagagtgggacagagagctggccagcaagaagaaccccaagctgatcaacgccctgagaagatgcttcttctggagattcatgttctacggcatcttcctgtacctgggcgaggtgaccaaggccgtgcagcccctgctgctgggcagaatcatcgccagctacgaccccgacaacaaggaggagagaagcatcgccatctacctgggcatcggcctgtgcctgctgttcatcgtgagaaccctgctgctgcaccccgccatcttcggcctgcaccacatcggcatgcagatgagaatcgccatgttcagcctgatctacaagaagaccctgaagctgagcagcagagtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcctactgctgggaggaggccatggagaagatgatcgagaacctgagacagaccgagctgaagctgaccagaaaggccgcctacgtgagatacttcaacagcagcgccttcttcttcagcggcttcttcgtggtgttcctgagcgtgctgccctacgccctgatcaagggcatcatcctgagaaagatcttcaccaccatcagcttctgcatcgtgctgagaatggccgtgaccagacagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggccagctgctggccgtggccggcagcaccggcgccggcaagaccagcctgctgatggtgatcatgggcgagctggagcccagcgagggcaagatcaagcacagcggcagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgccgagaaggacaacatcgtgctgggcgagggcggcatcaccctgagcggcggccagagagccagaatcagcctggccagagccgtgtacaaggacgccgacctgtacctgctggacagccccttcggctacctggacgtgctgaccgagaaggagatcttcgagagctgcgtgtgcaagctgatggccaacaagaccagaatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagagaagaaacagcatcctgaccgagaccctgcacagattcagcctggagggcgacgcccccgtgagctggaccgagaccaagaagcagagcttcaagcagaccggcgagttcggcgagaagagaaagaacagcatcctgaaccccatcaacagcatcagaaagttcagcatcgtgcagaagacccccctgcagatgaacggcatcgaggaggacagcgacgagcccctggagagaagactgagcctggtgcccgacagcgagcagggcgaggccatcctgcccagaatcagcgtgatcagcaccggccccaccctgcaggccagaagaagacagagcgtgctgaacctgatgacccacagcgtgaaccagggccagaacatccacagaaagaccaccgccagcaccagaaaggtgagcctggccccccaggccaacctgaccgagctggacatctacagcagaagactgagccaggagaccggcctggagatcagcgaggagatcaacgaggaggacctgaaggagtgcttcttcgacgacatggagagcatccccgccgtgaccacctggaacacctacctgagatacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagcagaaacaacagctacgccgtgatcatcaccagcaccagcagctactacgtgttctacatctacgtgggcgtggccgacaccctgctggccatgggcttcttcagaggcctgcccctggtgcacaccctgatcaccgtgagcaagatcctgcaccacaagatgctgcacagcgtgctgcaggcccccatgagcaccctgaacaccctgaaggccggcggcatcctgaacagattcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagagcctacttcctgcagaccagccagcagctgaagcagctggagagcgagggcagaagccccatcttcacccacctggtgaccagcctgaagggcctgtggaccctgagagccttcggcagacagccctacttcgagaccctgttccacaaggccctgaacctgcacaccgccaactggttcctgtacctgagcaccctgagatggttccagatgagaatcgagatgatcttcgtgatcttcttcatcgccgtgaccttcatcagcatcctgaccaccggcgagggcgagggcagagtgggcatcatcctgaccctggccatgaacatcatgagcaccctgcagtgggccgtgaacagcagcatcgacgtggacagcctgatgagaagcgtgagcagagtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagagtgggcctgctgggcagaaccggcagcggcaagagcaccctgctgagcgccttcctgagactgctgaacaccgagggcgagatccagatcgacggcgtgagctgggacagcatcaccctgcagcagtggagaaaggccttcggcgtgatcccccagaaggtgttcatcttcagcggcaccttcagaaagaacctggacccctacgagcagtggagcgaccaggagatctggaaggtggccgacgaggtgggcctgagaagcgtgatcgagcagttccccggcaagctggacttcgtgctggtggacggcggctgcgtgctgagccacggccacaagcagctgatgtgcctggccagaagcgtgctgagcaaggccaagatcctgctgctggacgagcccagcgcccacctggaccccgtgacctaccagatcatcagaagaaccctgaagcaggccttcgccgactgcaccgtgatcctgtgcgagcacagaatcgaggccatgctggagtgccagcagttcctggtgatcgaggagaacaaggtgagacagtacgacagcatccagaagctgctgaacgagagaagcctgttcagacaggccatcagccccagcgacagagtgaagctgttcccccacagaaacagcagcaagtgcaagagcaagccccagatcgccgccctgaaggaggagaccgaggaggaggtgcaggacaccagactgtag

SEQ ID NO: 1838 - DNA, 4317 bp, Artificial Sequence
  Description of Artificial Sequence: Synthetic coding sequence
atgcagagaagccccctggagaaggccagcgtggtgagcaagctgttcttcagctggaccagacccatcctgagaaagggctacagacagagactggagctgagcgacatctaccagatccccagcgtggacagcgccgacaacctgagcgagaagctggagagagagtgggacagagagctggccagcaagaagaaccccaagctgatcaacgccctgagaagatgcttcttctggagattcatgttctacggcatcttcctgtacctgggcgaggtgaccaaggccgtgcagcccctgctgctgggcagaatcatcgccagctacgaccccgacaacaaggaggagagaagcatcgccatctacctgggcatcggcctgtgcctgctgttcatcgtgagaaccctgctgctgcaccccgccatcttcggcctgcaccacatcggcatgcagatgagaatcgccatgttcagcctgatctacaagaagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcctactgctgggaggaggccatggagaagatgatcgagaacctgagacagaccgagctgaagctgaccagaaaggccgcctacgtgagatacttcaacagcagcgccttcttcttcagcggcttcttcgtggtgttcctgagcgtgctgccctacgccctgatcaagggcatcatcctgagaaagatcttcaccaccatcagcttctgcatcgtgctgagaatggccgtgaccagacagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggccagctgctggccgtggccggcagcaccggcgccggcaagaccagcctgctgatggtgatcatgggcgagctggagcccagcgagggcaagatcaagcacagcggcagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgccgagaaggacaacatcgtgctgggcgagggcggcatcaccctgagcggcggccagagagccagaatcagcctggccagagccgtgtacaaggacgccgacctgtacctgctggacagccccttcggctacctggacgtgctgaccgagaaggagatcttcgagagctgcgtgtgcaagctgatggccaacaagaccagaatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagagaagaaacagcatcctgaccgagaccctgcacagattcagcctggagggcgacgcccccgtgagctggaccgagaccaagaagcagagcttcaagcagaccggcgagttcggcgagaagagaaagaacagcatcctgaaccccatcaacagcatcagaaagttcagcatcgtgcagaagacccccctgcagatgaacggcatcgaggaggacagcgacgagcccctggagagaagactgagcctggtgcccgacagcgagcagggcgaggccatcctgcccagaatcagcgtgatcagcaccggccccaccctgcaggccagaagaagacagagcgtgctgaacctgatgacccacagcgtgaaccagggccagaacatccacagaaagaccaccgccagcaccagaaaggtgagcctggccccccaggccaacctgaccgagctggacatctacagcagaagactgagccaggagaccggcctggagatcagcgaggagatcaacgaggaggacctgaaggagtgcttcttcgacgacatggagagcatccccgccgtgaccacctggaacacctacctgagatacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagcagaaacaacagctacgccgtgatcatcaccagcaccagcagctactacgtgttctacatctacgtgggcgtggccgacaccctgctggccatgggcttcttcagaggcctgcccctggtgcacaccctgatcaccgtgagcaagatcctgcaccacaagatgctgcacagcgtgctgcaggcccccatgagcaccctgaacaccctgaaggccggcggcatcctgaacagattcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagagcctacttcctgcagaccagccagcagctgaagcagctggagagcgagggcagaagccccatcttcacccacctggtgaccagcctgaagggcctgtggaccctgagagccttcggcagacagccctacttcgagaccctgttccacaaggccctgaacctgcacaccgccaactggttcctgtacctgagcaccctgagatggttccagatgagaatcgagatgatcttcgtgatcttcttcatcgccgtgaccttcatcagcatcctgaccaccggcgagggcgagggcagagtgggcatcatcctgaccctggccatgaacatcatgagcaccctgcagtgggccgtgaacagcagcatcgacgtggacagcctgatgagaagcgtgagcagagtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagagtgggcctgctgggcagaaccggcagcggcaagagcaccctgctgagcgccttcctgagactgctgaacaccgagggcgagatccagatcgacggcgtgagctgggacagcatcaccctgcagcagtggagaaaggccttcggcgtgatcccccagaaggtgttcatcttcagcggcaccttcagaaagaacctggacccctacgagcagtggagcgaccaggagatctggaaggtggccgacgaggtgggcctgagaagcgtgatcgagcagttccccggcaagctggacttcgtgctggtggacggcggctgcgtgctgagccacggccacaagcagctgatgtgcctggccagaagcgtgctgagcaaggccaagatcctgctgctggacgagcccagcgcccacctggaccccgtgacctaccagatcatcagaagaaccctgaagcaggccttcgccgactgcaccgtgatcctgtgcgagcacagaatcgaggccatgctggagtgccagcagttcctggtgatcgaggagaacaaggtgagacagtacgacagcatccagaagctgctgaacgagagaagcctgttcagacaggccatcagccccagcgacagagtgaagctgttcccccacagaaacagcagcaagtgcaagagcaagccccagatcgccgccctgaagtag

SEQ ID NO: 1839 - DNA, 4260 bp, Artificial Sequence
  Description of Artificial Sequence: Synthetic coding sequence
atgcagagaagccccctggagaaggccagcgtggtgagcaagctgttcttcagctggaccagacccatcctgagaaagggctacagacagagactggagctgagcgacatctaccagatccccagcgtggacagcgccgacaacctgagcgagaagctggagagagagtgggacagagagctggccagcaagaagaaccccaagctgatcaacgccctgagaagatgcttcttctggagattcatgttctacggcatcttcctgtacctgggcgaggtgaccaaggccgtgcagcccctgctgctgggcagaatcatcgccagctacgaccccgacaacaaggaggagagaagcatcgccatctacctgggcatcggcctgtgcctgctgttcatcgtgagaaccctgctgctgcaccccgccatcttcggcctgcaccacatcggcatgcagatgagaatcgccatgttcagcctgatctacaagaagaccctgaagctgagcagcagagtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcctactgctgggaggaggccatggagaagatgatcgagaacctgagacagaccgagctgaagctgaccagaaaggccgcctacgtgagatacttcaacagcagcgccttcttcttcagcggcttcttcgtggtgttcctgagcgtgctgccctacgccctgatcaagggcatcatcctgagaaagatcttcaccaccatcagcttctgcatcgtgctgagaatggccgtgaccagacagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagaccagcctgctgatggtgatcatgggcgagctggagcccagcgagggcaagatcaagcacagcggcagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgccgagaaggacaacatcgtgctgggcgagggcggcatcaccctgagcggcggccagagagccagaatcagcctggccagagccgtgtacaaggacgccgacctgtacctgctggacagccccttcggctacctggacgtgctgaccgagaaggagatcttcgagagctgcgtgtgcaagctgatggccaacaagaccagaatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagagaagaaacagcatcctgaccgagaccctgcacagattcagcctggagggcgacgcccccgtgagctggaccgagaccaagaagcagagcttcaagcagaccggcgagttcggcgagaagagaaagaacagcatcctgaaccccatcaacagcatcagaaagttcagcatcgtgcagaagacccccctgcagatgaacggcatcgaggaggacagcgacgagcccctggagagaagactgagcctggtgcccgacagcgagcagggcgaggccatcctgcccagaatcagcgtgatcagcaccggccccaccctgcaggccagaagaagacagagcgtgctgaacctgatgacccacagcgtgaaccagggccagaacatccacagaaagaccaccgccagcaccagaaaggtgagcctggccccccaggccaacctgaccgagctggacatctacagcagaagactgagccaggagaccggcctggagatcagcgaggagatcaacgaggaggacctgaaggagtgcttcttcgacgacatggagagcatccccgccgtgaccacctggaacacctacctgagatacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagcagaaacaacagctacgccgtgatcatcaccagcaccagcagctactacgtgttctacatctacgtgggcgtggccgacaccctgctggccatgggcttcttcagaggcctgcccctggtgcacaccctgatcaccgtgagcaagatcctgcaccacaagatgctgcacagcgtgctgcaggcccccatgagcaccctgaacaccctgaaggccggcggcatcctgaacagattcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagagcctacttcctgcagaccagccagcagctgaagcagctggagagcgagggcagaagccccatcttcacccacctggtgaccagcctgaagggcctgtggaccctgagagccttcggcagacagccctacttcgagaccctgttccacaaggccctgaacctgcacaccgccaactggttcctgtacctgagcaccctgagatggttccagatgagaatcgagatgatcttcgtgatcttcttcatcgccgtgaccttcatcagcatcctgaccaccggcgagggcgagggcagagtgggcatcatcctgaccctggccatgaacatcatgagcaccctgcagtgggccgtgaacagcagcatcgacgtggacagcctgatgagaagcgtgagcagagtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagagtgggcctgctgggcagaaccggcagcggcaagagcaccctgctgagcgccttcctgagactgctgaacaccgagggcgagatccagatcgacggcgtgagctgggacagcatcaccctgcagcagtggagaaaggccttcggcgtgatcccccagaaggtgttcatcttcagcggcaccttcagaaagaacctggacccctacgagcagtggagcgaccaggagatctggaaggtggccgacgaggtgggcctgagaagcgtgatcgagcagttccccggcaagctggacttcgtgctggtggacggcggctgcgtgctgagccacggccacaagcagctgatgtgcctggccagaagcgtgctgagcaaggccaagatcctgctgctggacgagcccagcgcccacctggaccccgtgacctaccagatcatcagaagaaccctgaagcaggccttcgccgactgcaccgtgatcctgtgcgagcacagaatcgaggccatgctggagtgccagcagttcctggtgatcgaggagaacaaggtgagacagtacgacagcatccagaagctgctgaacgagagaagcctgttcagacaggccatcagccccagcgacagagtgaagctgttcccccacagaaacagcagcaagtgcaagagcaagccccagatcgccgccctgaaggaggagaccgaggaggaggtgcaggacaccagactgtag

SEQ ID NO: 1840 - DNA, 573 bp, Artificial Sequence
  Description of Artificial Sequence: Synthetic coding sequence
tgaaagggcctgtggaccctgagagccttcggcagacagccctacttcgagaccctgttccacaaggccctgaacctgcacaccgccaactggttcctgtacctgagcaccctgagatggttccagatgagaatcgagatgatcttcgtgatcttcttcatcgccgtgaccttcatcagcatcctgaccaccggcgagggcgagggcagagtgggcatcatcctgaccctggccatgaacatcatgagcaccctgcagtgggccgtgaacagcagcatcgacgtggacagcctgatgagaagcgtgagcagagtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagagtgagattcgagcactgcctgctgtgctag

SEQ ID NO: 1841 - DNA, 1203 bp, Artificial Sequence
  Description of Artificial Sequence: Synthetic coding sequence
atgatcagaaactggctgaccatcttcatcctgttccccctgaagctggtggagaagtgcgagagcagcgtgagcctgaccgtgccccccgtggtgaagctggagaacggcagcagcaccaacgtgagcctgaccctgagaccccccctgaacgccaccctggtgatcaccttcgagatcaccttcagaagcaagaacatcaccatcctggagctgcccgacgaggtggtggtgccccccggcgtgaccaacagcagcttccaggtgaccagccagaacgtgggccagctgaccgtgtacctgcacggcaaccacagcaaccagaccggccccagaatcagattcctggtgatcagaagcagcgccatcagcatcatcaaccaggtgatcggctggatctacttcgtggcctggagcatcagcttctacccccaggtgatcatgaactggagaagaaagagcgtgatcggcctgagcttcgacttcgtggccctgaacctgaccggcttcgtggcctacagcgtgttcaacatcggcctgctgtgggtgccctacatcaaggagcagttcctgctgaagtaccccaacggcgtgaaccccgtgaacagcaacgacgtgttcttcagcctgcacgccgtggtgctgaccctgatcatcatcgtgcagtgctgcctgtacgagagaggcggccagagagtgagctggcccgccatcggcttcctggtgctggcctggctgttcgccttcgtgaccatgatcgtggccgccgtgggcgtgaccacctggctgcagttcctgttctgcttcagctacatcaagctggccgtgaccctggtgaagtacttcccccaggcctacatgaacttctactacaagagcaccgagggctggagcatcggcaacgtgctgctggacttcaccggcggcagcttcagcctgctgcagatgttcctgcagagctacaacaacgaccagtggaccctgatcttcggcgaccccaccaagttcggcctgggcgtgttcagcatcgtgttcgacgtggtgttcttcatccagcacttctgcctgtacagaaagagacccggcctgcaggccgccagaaccggcagcggcagcagactgagacaggactgggcccccagcctgcagcccaaggccctgccccagaccaccagcgtgagcgccagcagcctgaagggctag

SEQ ID NO: 1842 - DNA, 1104 bp, Artificial Sequence
  Description of Artificial Sequence: Synthetic coding sequence
atgatcagaaactggctgaccatcttcatcctgttccccctgaagctggtggagaagtgcgagagcagcgtgagcctgaccgtgccccccgtggtgaagctggagaacggcagcagcaccaacgtgagcctgaccctgagaccccccctgaacgccaccctggtgatcaccttcgagatcaccttcagaagcaagaacatcaccatcctggagctgcccgacgaggtggtggtgccccccggcgtgaccaacagcagcttccaggtgaccagccagaacgtgggccagctgaccgtgtacctgcacggcaaccacagcaaccagaccggccccagaatcagattcctggtgatcagaagcagcgccatcagcatcatcaaccaggtgatcggctggatctacttcgtggcctggagcatcagcttctacccccaggtgatcatgaactggagaagaaagagcgtgatcggcctgagcttcgacttcgtggccctgaacctgaccggcttcgtggcctacagcgtgttcaacatcggcctgctgtgggtgccctacatcaaggagcagttcctgctgaagtaccccaacggcgtgaaccccgtgaacagcaacgacgtgttcttcagcctgcacgccgtggtgctgaccctgatcatcatcgtgcagtgctgcctgtacgagagaggcggccagagagtgagctggcccgccatcggcttcctggtgctggcctggctgttcgccttcgtgaccatgatcgtggccgccgtgggcgtgaccacctggctgcagttcctgttctgcttcagctacatcaagctggccgtgaccctggtgaagtacttcccccaggcctacatgaacttctactacaagagcaccgagggctggagcatcggcaacgtgctgctggacttcaccggcggcagcttcagcctgctgcagatgttcctgcagagctacaacaacgaccagtggaccctgatcttcggcgaccccaccaagttcggcctgggcgtgttcagcatcgtgttcgacgtggtgttcttcatccagcacttctgcctgtacagaaagagacccggctacgaccagctgaactag

SEQ ID NO: 1843 - DNA, 663 bp, Artificial Sequence
  Description of Artificial Sequence: Synthetic coding sequence
atgaactggagaagaaagagcgtgatcggcctgagcttcgacttcgtggccctgaacctgaccggcttcgtggcctacagcgtgttcaacatcggcctgctgtgggtgccctacatcaaggagcagttcctgctgaagtaccccaacggcgtgaaccccgtgaacagcaacgacgtgttcttcagcctgcacgccgtggtgctgaccctgatcatcatcgtgcagtgctgcctgtacgagagaggcggccagagagtgagctggcccgccatcggcttcctggtgctggcctggctgttcgccttcgtgaccatgatcgtggccgccgtgggcgtgaccacctggctgcagttcctgttctgcttcagctacatcaagctggccgtgaccctggtgaagtacttcccccaggcctacatgaacttctactacaagagcaccgagggctggagcatcggcaacgtgctgctggacttcaccggcggcagcttcagcctgctgcagatgttcctgcagagctacaacaacgaccagtggaccctgatcttcggcgaccccaccaagttcggcctgggcgtgttcagcatcgtgttcgacgtggtgttcttcatccagcacttctgcctgtacagaaagagacccggctacgaccagctgaactag

SEQ ID NO: 1844 - DNA, 879 bp, Artificial Sequence
  Description of Artificial Sequence: Synthetic coding sequence
atgtgccccagaatcagattcctggtgatcagaagcagcgccatcagcatcatcaaccaggtgatcggctggatctacttcgtggcctggagcatcagcttctacccccaggtgatcatgaactggagaagaaagagcgtgatcggcctgagcttcgacttcgtggccctgaacctgaccggcttcgtggcctacagcgtgttcaacatcggcctgctgtgggtgccctacatcaaggagcagttcctgctgaagtaccccaacggcgtgaaccccgtgaacagcaacgacgtgttcttcagcctgcacgccgtggtgctgaccctgatcatcatcgtgcagtgctgcctgtacgagagaggcggccagagagtgagctggcccgccatcggcttcctggtgctggcctggctgttcgccttcgtgaccatgatcgtggccgccgtgggcgtgaccacctggctgcagttcctgttctgcttcagctacatcaagctggccgtgaccctggtgaagtacttcccccaggcctacatgaacttctactacaagagcaccgagggctggagcatcggcaacgtgctgctggacttcaccggcggcagcttcagcctgctgcagatgttcctgcagagctacaacaacgaccagtggaccctgatcttcggcgaccccaccaagttcggcctgggcgtgttcagcatcgtgttcgacgtggtgttcttcatccagcacttctgcctgtacagaaagagacccggcctgcaggccgccagaaccggcagcggcagcagactgagacaggactgggcccccagcctgcagcccaaggccctgccccagaccaccagcgtgagcgccagcagcctgaagggctag

SEQ ID NO: 1845 - DNA, 228 bp, Artificial Sequence
  Description of Artificial Sequence: Synthetic coding sequence
atgatcagaaactggctgaccatcttcatcctgttccccctgaagctggtggagaagtgcgagagcagcgtgagcctgaccgtgccccccgtggtgaagctggagaacggcagcagcaccaacgtgagcctgaccctgagaccccccctgaacgccaccctggtgatcaccttcgagatcaccttcagaagcaagaacatcaccatcctggagctgcccgacgagtag

SEQ ID NO: 1846 - DNA, 204 bp, Artificial Sequence
  Description of Artificial Sequence: Synthetic coding sequence
atgagaatccactacctgctgttcgccctgctgttcctgttcctggtgcccgtgcccggccacggcggcatcatcaacaccctgcagaagtactactgcagagtgagaggcggcagatgcgccgtgctgagctgcctgcccaaggaggagcagatcggcaagtgcagcaccagaggcagaaagtgctgcagaagaaagaagtag

SEQ ID NO: 1847 - DNA, 204 bp, Artificial Sequence; identical to SEQ ID NO: 1846
  Description of Artificial Sequence: Synthetic coding sequence

SEQ ID NO: 1848 - DNA, 195 bp, Artificial Sequence
  Description of Artificial Sequence: Synthetic coding sequence
atgagagtgctgtacctgctgttcagcttcctgttcatcttcctgatgcccctgcccggcgtgttcggcggcatcggcgaccccgtgacctgcctgaagagcggcgccatctgccaccccgtgttctgccccagaagatacaagcagatcggcacctgcggcctgcccggcaccaagtgctgcaagaagccctag

SEQ ID NO: 1849 - DNA, 195 bp, Artificial Sequence; identical to SEQ ID NO: 1848
  Description of Artificial Sequence: Synthetic coding sequence

SEQ ID NO: 1850 - DNA, 849 bp, Artificial Sequence
  Description of Artificial Sequence: Synthetic coding sequence
atgagaggcatgaagctgctgggcgccctgctggccctggccgccctgctgcagggcgccgtgagcctgaagatcgccgccttcaacatccagaccttcggcgagaccaagatgagcaacgccaccctggtgagctacatcgtgcagatcctgagcagatacgacatcgccctggtgcaggaggtgagagacagccacctgaccgccgtgggcaagctgctggacaacctgaaccaggacgcccccgacacctaccactacgtggtgagcgagcccctgggcagaaacagctacaaggagagatacctgttcgtgtacagacccgaccaggtgagcgccgtggacagctactactacgacgacggctgcgagccctgcggcaacgacaccttcaacagagagcccgccatcgtgagattcttcagcagattcaccgaggtgagagagttcgccatcgtgcccctgcacgccgcccccggcgacgccgtggccgagatcgacgccctgtacgacgtgtacctggacgtgcaggagaagtggggcctggaggacgtgatgctgatgggcgacttcaacgccggctgcagctacgtgagacccagccagtggagcagcatcagactgtggaccagccccaccttccagtggctgatccccgacagcgccgacaccaccgccacccccacccactgcgcctacgacagaatcgtggtggccggcatgctgctgagaggcgccgtggtgcccgacagcgccctgcccttcaacttccaggccgcctacggcctgagcgaccagctggcccaggccatcagcgaccactaccccgtggaggtgatgctgaagtag

SEQ ID NO: 1851 - DNA, 849 bp, Artificial Sequence; identical to SEQ ID NO: 1850
  Description of Artificial Sequence: Synthetic coding sequence

SEQ ID NO: 1852 - DNA, 564 bp, Artificial Sequence
  Description of Artificial Sequence: Synthetic coding sequence
atgcaccagacccccatcaccacctggagcgtgagccactgggacggcaccgccatcagaagcgccacctgcagctgcaccggcctgaccagatgcctgagatggaccgccaccaccaccatgatggccgccagccccgccggcaccacccccagcaccgagagccagcccctgagcggcagcagccccggcagccaggacgtgatgctgatgggcgacttcaacgccggctgcagctacgtgagacccagccagtggagcagcatcagactgtggaccagccccaccttccagtggctgatccccgacagcgccgacaccaccgccacccccacccactgcgcctacgacagaatcgtggtggccggcatgctgctgagaggcgccgtggtgcccgacagcgccctgcccttcaacttccaggccgcctacggcctgagcgaccagctgttcagcgtgcacacctgcagcggcgccggcctgggcgagagacacggcctgcccgccagcgccgccctgcccagcaacacctgcagagccggcacccacagagtgagcacctag

SEQ ID NO: 1853 - DNA, 6243 bp, Artificial Sequence
  Description of Artificial Sequence: Synthetic coding sequence
atgctgagagtgttcatcctgtacgccgagaacgtgcacacccccgacaccgacatcagcgacgcctactgcagcgccgtgttcgccggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1854 - DNA, 6246 bp, Artificial Sequence
  Description of Artificial Sequence: Synthetic coding sequence
atgctgtgctgcctgctggtgagagccagcaacctgcccagcgccaagaaggacagaagaagcgaccccgtggccagcctgaccttcagaggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1855 - DNA, 6309 bp, Artificial Sequence
  Description of Artificial Sequence: Synthetic coding sequence
atgctgtgctgcctgctggtgagagccagcaacctgcccagcgccaagaaggacagaagaagcgaccccgtggccagcctgaccttcagaggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1856 - DNA, 6357 bp, Artificial Sequence
  Description of Artificial Sequence: Synthetic coding sequence
atgctgagagtgttcatcctgtacgccgagaacgtgcacacccccgacaccgacatcagcgacgcctactgcagcgccgtgttcgccggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagcagagccgagacctggagcctgctgagcgacagcaccatggacaccagatacagcggcaagaagtggcccgcccccaccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggtggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1857 - DNA, 6339 bp, Artificial Sequence
  Description of Artificial Sequence: Synthetic coding sequence
atgctgtgctgcctgctggtgagagccagcaacctgcccagcgccaagaaggacagaagaagcgaccccgtggccagcctgaccttcagaggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagcagagccgagacctggagcctgctgagcgacagcaccatggacaccagatacagcggcaagaagtggcccgcccccaccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1858 - DNA, 6267 bp, Artificial Sequence
  Description of Artificial Sequence: Synthetic coding sequence
atgctgtgctgcctgctggtgagagccagcaacctgcccagcgccaagaaggacagaagaagcgaccccgtggccagcctgaccttcagaggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggtggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1859 - DNA, 6294 bp, Artificial Sequence
  Description of Artificial Sequence: Synthetic coding sequence
atgctgagagtgttcatcctgtacgccgagaacgtgcacacccccgacaccgacatcagcgacgcctactgcagcgccgtgttcgccggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagcagagccgagacctggagcctgctgagcgacagcaccatggacaccagatacagcggcaagaagtggcccgcccccaccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggtggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1860 - DNA, 6360 bp, Artificial Sequence
  Description of Artificial Sequence: Synthetic coding sequence
atgctgtgctgcctgctggtgagagccagcaacctgcccagcgccaagaaggacagaagaagcgaccccgtggccagcctgaccttcagaggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagcagagccgagacctggagcctgctgagcgacagcaccatggacaccagatacagcggcaagaagtggcccgcccccaccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggtggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1861 - DNA, 6297 bp, Artificial Sequence
  Description of Artificial Sequence: Synthetic coding sequence
atgctgtgctgcctgctggtgagagccagcaacctgcccagcgccaagaaggacagaagaagcgaccccgtggccagcctgaccttcagaggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagcagagccgagacctggagcctgctgagcgacagcaccatggacaccagatacagcggcaagaagtggcccgcccccaccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggtggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1862 - DNA, 6336 bp, Artificial Sequence
  Description of Artificial Sequence: Synthetic coding sequence
atgctgagagtgttcatcctgtacgccgagaacgtgcacacccccgacaccgacatcagcgacgcctactgcagcgccgtgttcgccggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccggcggcggccagagcagagccgagacctggagcctgctgagcgacagcaccatggacaccagatacagcggcaagaagtggcccgcccccaccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccaggaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1863 - DNA, 6306 bp, Artificial Sequence
  Description of Artificial Sequence: Synthetic coding sequence
atgctgagagtgttcatcctgtacgccgagaacgtgcacacccccgacaccgacatcagcgacgcctactgcagcgccgtgttcgccggcgtgaagaagagaaccaaggtgatcaagaacagcgtgaaccccgtgtggaacgagggcttcgagtgggacctgaagggcatccccctggaccagggcagcgagctgcacgtggtggtgaaggaccacgagaccatgggcagaaacagattcctgggcgaggccaaggtgcccctgagagaggtgctggccacccccagcctgagcgccagcttcaacgcccccctgctggacaccaagaagcagcccaccggcgccagcctggtgctgcaggtgagctacacccccctgcccggcgccgtgcccctgttccccccccccacccccctggagcccagccccaccctgcccgacctggacgtggtggccgacaccggcggcgaggaggacaccgaggaccagggcctgaccggcgacgaggccgagcccttcctggaccagagcggcggccccggcgcccccaccacccccagaaagctgcccagcagaccccccccccactaccccggcatcaagagaaagagaagcgcccccaccagcagaaagctgctgagcgacaagccccaggacttccagatcagagtgcaggtgatcgagggcagacagctgcccggcgtgaacatcaagcccgtggtgaaggtgaccgccgccggccagaccaagagaaccagaatccacaagggcaacagccccctgttcaacgagaccctgttcttcaacctgttcgacagccccggcgagctgttcgacgagcccatcttcatcaccgtggtggacagcagaagcctgagaaccgacgccctgctgggcgagttcagaatggacgtgggcaccatctacagagagcccagacacgcctacctgagaaagtggctgctgctgagcgaccccgacgacttcagcgccggcgccagaggctacctgaagaccagcctgtgcgtgctgggccccggcgacgaggcccccctggagagaaaggaccccagcgaggacaaggaggacatcgagagcaacctgctgagacccaccggcgtggccctgagaggcgcccacttctgcctgaaggtgttcagagccgaggacctgccccagatggacgacgccgtgatggacaacgtgaagcagatcttcggcttcgagagcaacaagaagaacctggtggaccccttcgtggaggtgagcttcgccggcaagatgctgtgcagcaagatcctggagaagaccgccaacccccagtggaaccagaacatcaccctgcccgccatgttccccagcatgtgcgagaagatgagaatcagaatcatcgactgggacagactgacccacaacgacatcgtggccaccacctacctgagcatgagcaagatcagcgcccccggcggcgagatcgaggaggagcccgccggcgccgtgaagcccagcaaggccagcgacctggacgactacctgggcttcctgcccaccttcggcccctgctacatcaacctgtacggcagccccagagagttcaccggcttccccgacccctacaccgagctgaacaccggcaagggcgagggcgtggcctacagaggcagactgctgctgagcctggagaccaagctggtggagcacagcgagcagaaggtggaggacctgcccgccgacgacatcctgagagtggagaagtacctgagaagaagaaagtacagcctgttcgccgccttctacagcgccaccatgctgcaggacgtggacgacgccatccagttcgaggtgagcatcggcaactacggcaacaagttcgacatgacctgcctgcccctggccagcaccacccagtacagcagagccgtgttcgacggctgccactactactacctgccctggggcaacgtgaagcccgtggtggtgctgagcagctactgggaggacatcagccacagaatcgagacccagaaccagctgctgggcatcgccgacagactggaggccggcctggagcaggtgcacctggccctgaaggcccagtgcagcaccgaggacgtggacagcctggtggcccagctgaccgacgagctgatcgccggctgcagccagcccctgggcgacatccacgagacccccagcgccacccacctggaccagtacctgtaccagctgagaacccaccacctgagccagatcaccgaggccgccctggccctgaagctgggccacagcgagctgcccgccgccctggagcaggccgaggactggctgctgagactgagagccctggccgaggagccccagaacagcctgcccgacatcgtgatctggatgctgcagggcgacaagagagtggcctaccagagagtgcccgcccaccaggtgctgttcagcagaagaggcgccaactactgcggcaagaactgcggcaagctgcagaccatcttcctgaagtaccccatggagaaggtgcccggcgccagaatgcccgtgcagatcagagtgaagctgtggttcggcctgagcgtggacgagaaggagttcaaccagttcgccgagggcaagctgagcgtgttcgccgagacctacgagaacgagaccaagctggccctggtgggcaactggggcaccaccggcctgacctaccccaagttcagcgacgtgaccggcaagatcaagctgcccaaggacagcttcagacccagcgccggctggacctgggccggcgactggttcgtgtgccccgagaagaccctgctgcacgacatggacgccggccacctgagcttcgtggaggaggtgttcgagaaccagaccagactgcccggcggccagtggatctacatgagcgacaactacaccgacgtgaacggcgagaaggtgctgcccaaggacgacatcgagtgccccctgggctggaagtgggaggacgaggagtggagcaccgacctgaacagagccgtggacgagcagggctgggagtacagcatcaccatcccccccgagagaaagcccaagcactgggtgcccgccgagaagatgtactacacccacagaagaagaagatgggtgagactgagaagaagagacctgagccagatggaggccctgaagagacacagacaggccgaggccgagggcgagggctgggagtacgccagcctgttcggctggaagttccacctggagtacagaaagaccgacgccttcagaagaagaagatggagaagaagaatggagcccctggagaagaccggccccgccgccgtgttcgccctggagggcgccctgggcggcgtgatggacgacaagagcgaggacagcatgagcgtgagcaccctgagcttcggcgtgaacagacccaccatcagctgcatcttcgactacggcaacagataccacctgagatgctacatgtaccaggccagagacctggccgccatggacaaggacagcttcagcgacccctacgccatcgtgagcttcctgcaccagagccagaagaccgtggtggtgaagaacaccctgaaccccacctgggaccagaccctgatcttctacgagatcgagatcttcggcgagcccgccaccgtggccgagcagccccccagcatcgtggtggagctgtacgaccacgacacctacggcgccgacgagttcatgggcagatgcatctgccagcccagcctggagagaatgcccagactggcctggttccccctgaccagaggcagccagcccagcggcgagctgctggccagcttcgagctgatccagagagagaagcccgccatccaccacatccccggcttcgaggtgcaggagaccagcagaatcctggacgagagcgaggacaccgacctgccctacccccccccccagagagaggccaacatctacatggtgccccagaacatcaagcccgccctgcagagaaccgccatcgagatcctggcctggggcctgagaaacatgaagagctaccagctggccaacatcagcagccccagcctggtggtggagtgcggcggccagaccgtgcagagctgcgtgatcagaaacctgagaaagaaccccaacttcgacatctgcaccctgttcatggaggtgatgctgcccagagaggagctgtactgcccccccatcaccgtgaaggtgatcgacaacagacagttcggcagaagacccgtggtgggccagtgcaccatcagaagcctggagagcttcctgtgcgacccctacagcgccgagagccccagcccccagggcggccccgacgacgtgagcctgctgagccccggcgaggacgtgctgatcgacatcgacgacaaggagcccctgatccccatccagctggccgacggcctgagcagcctggcccccaccaacaccgccagcccccccagcagcccccacgaggaggagttcatcgactggtggagcaagttcttcgccagcatcggcgagagagagaagtgcggcagctacctggagaaggacttcgacaccctgaaggtgtacgacacccagctggagaacgtggaggccttcgagggcctgagcgacttctgcaacaccttcaagctgtacagaggcaagacccaggaggagaccgaggaccccagcgtgatcggcgagttcaagggcctgttcaagatctaccccctgcccgaggaccccgccatccccatgccccccagacagttccaccagctggccgcccagggcccccaggagtgcctggtgagaatctacatcgtgagagccttcggcctgcagcccaaggaccccaacggcaagtgcgacccctacatcaagatcagcatcggcaagaagagcgtgagcgaccaggacaactacatcccctgcaccctggagcccgtgttcggcaagatgttcgagctgacctgcaccctgcccctggagaaggacctgaagatcaccctgtacgactacgacctgctgagcaaggacgagaagatcggcgagaccgtggtggacctggagaacagactgctgagcaagttcggcgccagatgcggcctgccccagacctactgcgtgagcggccccaaccagtggagagaccagctgagacccagccagctgctgcacctgttctgccagcagcacagagtgaaggcccccgtgtacagaaccgacagagtgatgttccaggacaaggagtacagcatcgaggagatcgaggccggcagaatccccaacccccacctgggccccgtggaggagagactggccctgcacgtgctgcagcagcagggcctggtgcccgagcacgtggagagcagacccctgtacagccccctgcagcccgacatcgagcagggcaagctgcagatgtgggtggacctgttccccaaggccctgggcagacccggcccccccttcaacatcacccccagaagagccagaagattcttcctgagatgcatcatctggaacaccagagacgtgatcctggacgacctgagcctgaccggcgagaagatgagcgacatctacgtgaagggctggatgatcggcttcgaggagcacaagcagaagaccgacgtgcactacagaagcctgggcggcgagggcaacttcaactggagattcatcttccccttcgactacctgcccgccgagcaggtgtgcaccatcgccaagaaggacgccttctggagactggacaagaccgagagcaagatccccgccagagtggtgttccagatctgggacaacgacaagttcagcttcgacgacttcctgggcagcctgcagctggacctgaacagaatgcccaagcccgccaagaccgccaagaagtgcagcctggaccagctggacgacgccttccaccccgagtggttcgtgagcctgttcgagcagaagaccgtgaagggctggtggccctgcgtggccgaggagggcgagaagaagatcctggccggcaagctggagatgaccctggagatcgtggccgagagcgagcacgaggagagacccgccggccagggcagagacgagcccaacatgaaccccaagctggaggaccccagaagacccgacaccagcttcctgtggttcaccagcccctacaagaccatgaagttcatcctgtggagaagattcagatgggccatcatcctgttcatcatcctgttcatcctgctgctgttcctggccatcttcatctacgccttccccaactacgccgccatgaagctggtgaagcccttcagctag

SEQ ID NO: 1864 - DNA, 447 bp, Artificial Sequence
  Description of Artificial Sequence: Synthetic coding sequence
atgggctaccccgaggtggagagaagagagctgctgcccgccgccgcccccagagagagaggcagccagggctgcggctgcggcggcgcccccgccagagccggcgagggcaacagctgcctgctgttcctgggcttcttcggcctgagcctggccctgcacctgctgaccctgtgctgctacctggagctgagaagcgagctgagaagagagagaggcgccgagagcagactgggcggcagcggcacccccggcaccagcggcaccctgagcagcctgggcggcctggaccccgacagccccatcaccagccacctgggccagcccagccccaagcagcagcccctggagcccggcgaggccgccctgcacagcgacagccaggacggccaccaggacttcgactacatcatcagcttcagctacggcctgcagggcttctgctag

SEQ ID NO: 1865 - DNA, 1176 bp, Artificial Sequence
  Description of Artificial Sequence: Synthetic coding sequence
atgggctaccccgaggtggagagaagagagctgctgcccgccgccgcccccagagagagaggcagccagggctgcggctgcggcggcgcccccgccagagccggcgagggcaacagctgcctgctgttcctgggcttcttcggcctgagcctggccctgcacctgctgaccctgtgctgctacctggagctgagaagcgagctgagaagagagagaggcgccgagagcagactgggcggcagcggcacccccggcaccagcggcaccctgagcagcctgggcggcctggaccccgacagccccatcaccagccacctgggccagcccagccccaagcagcagcccctggagcccggcgaggccgccctgcacagcgacagccaggacggccaccagatggccctgctgaacttcttcttccccgacgagaagccctacagcgaggaggagagcagaagagtgagaagaaacaagagaagcaagagcaacgagggcgccgacggccccgtgaagaacaagaagaagggcaagaaggccggcccccccggccccaacggcccccccggcccccccggcccccccggcccccagggcccccccggcatccccggcatccccggcatccccggcaccaccgtgatgggcccccccggcccccccggcccccccggcccccagggcccccccggcctgcagggccccagcggcgccgccgacaaggccggcaccagagagaaccagcccgccgtggtgcacctgcagggccagggcagcgccatccaggtgaagaacgacctgagcggcggcgtgctgaacgactggagcagaatcaccatgaaccccaaggtgttcaagctgcaccccagaagcggcgagctggaggtgctggtggacggcacctacttcatctacagccaggtggaggtgtactacatcaacttcaccgacttcgccagctacgaggtggtggtggacgagaagcccttcctgcagtgcaccagaagcatcgagaccggcaagaccaactacaacacctgctacaccgccggcgtgtgcctgctgaaggccagacagaagatcgccgtgaagatggtgcacgccgacatcagcatcaacatgagcaagcacaccaccttcttcggcgccatcagactgggcgaggcccccgccagctag

SEQ ID NO: 1866 - DNA, 1170 bp, Artificial Sequence
  Description of Artificial Sequence: Synthetic coding sequence
atgggctaccccgaggtggagagaagagagctgctgcccgccgccgcccccagagagagaggcagccagggctgcggctgcggcggcgcccccgccagagccggcgagggcaacagctgcctgctgttcctgggcttcttcggcctgagcctggccctgcacctgctgaccctgtgctgctacctggagctgagaagcgagctgagaagagagagaggcgccgagagcagactgggcggcagcggcacccccggcaccagcggcaccctgagcagcctgggcggcctggaccccgacagccccatcaccagccacctgggccagcccagccccaagcagcagcccctggagcccggcgaggccgccctgcacagcgacagccaggacggccaccagatggccctgctgaacttcttcttccccgacgagaagccctacagcgaggaggagagcagaagagtgagaagaaacaagagaagcaagagcaacgagggcgccgacggccccgtgaagaacaagaagaagggcaagaaggccggcccccccggccccaacggcccccccggcccccccggcccccccggcccccagggcccccccggcatccccggcatccccggcatccccggcaccaccgtgatgggcccccccggcccccccggcccccccggcccccagggcccccccggcctgcagggccccagcggcgccgccgacaaggccggcaccagagagaaccagcccgccgtggtgcacctgcagggccagggcagcgccatccaggtgaagaacgacctgagcggcggcgtgctgaacgactggagcagaatcaccatgaaccccaaggtgttcaagctgcaccccagaagcggcgagctggaggtgctggtggacggcacctacttcatctacagccaggtgtactacatcaacttcaccgacttcgccagctacgaggtggtggtggacgagaagcccttcctgcagtgcaccagaagcatcgagaccggcaagaccaactacaacacctgctacaccgccggcgtgtgcctgctgaaggccagacagaagatcgccgtgaagatggtgcacgccgacatcagcatcaacatgagcaagcacaccaccttcttcggcgccatcagactgggcgaggcccccgccagctag

SEQ ID NO: 1867 - DNA, 408 bp, Artificial Sequence
  Description of Artificial Sequence: Synthetic coding sequence
atgggctaccccgaggtggagagaagagagctgctgcccgccgccgcccccagagagagaggcagccagggctgcggctgcggcggcgcccccgccagagccggcgagggcaacagctgcctgctgttcctgggcttcttcggcctgagcctggccctgcacctgctgaccctgtgctgctacctggagctgagaagcgagctgagaagagagagaggcgccgagagcagactgggcggcagcggcacccccggcaccagcggcaccctgagcagcctgggcggcctggaccccgacagccccatcaccagccacctgggccagcccagccccaagcagcagcccctggagcccggcgaggccgccctgcacagcgacagccaggacggccaccagggccaccagtag

SEQ ID NO: 1868 - DNA, 1161 bp, Artificial Sequence
  Description of Artificial Sequence: Synthetic coding sequence
atgggctaccccgaggtggagagaagagagctgctgcccgccgccgcccccagagagagaggcagccagggctgcggctgcggcggcgcccccgccagagccggcgagggcaacagctgcctgctgttcctgggcttcttcggcctgagcctggccctgcacctgctgaccctgtgctgctacctggagctgagaagcgagctgagaagagagagaggcgccgagagcagactgggcggcagcggcacccccggcaccagcggcaccctgagcagcctgggcggcctggaccccgacagccccatcaccagccacctgggccagcccagccccaagcagcagcccctggagcccggcgaggccgccctgcacagcgacagccaggacggccaccagatggccctgctgaacttcttcttccccgacgagaagccctacagcgaggaggagagcagaagagtgagaagaaacaagagaagcaagagcaacgagggcgccgacggccccgtgaagaacaagaagaagggcaagaaggccggcccccccggccccaacggcccccccggcccccccggcccccccggcccccagggcccccccggcatccccggcatccccggcatccccggcaccaccgtgatgggcccccccggcccccccggcccccccggcccccagggcccccccggcctgcagggccccagcggcgccgccgacaaggccggcaccagagagaaccagcccgccgtggtgcacctgcagggccagggcagcgccatccaggtgaagaacggcggcgtgctgaacgactggagcagaatcaccatgaaccccaaggtgttcaagctgcaccccagaagcggcgagctggaggtgctggtggacggcacctacttcatctacagccaggtgtactacatcaacttcaccgacttcgccagctacgaggtggtggtggacgagaagcccttcctgcagtgcaccagaagcatcgagaccggcaagaccaactacaacacctgctacaccgccggcgtgtgcctgctgaaggccagacagaagatcgccgtgaagatggtgcacgccgacatcagcatcaacatgagcaagcacaccaccttcttcggcgccatcagactgggcgaggcccccgccagctag

SEQ ID NO: 1869 - DNA, 447 bp, Artificial Sequence; identical to SEQ ID NO: 1864
  Description of Artificial Sequence: Synthetic coding sequence

SEQ ID NO: 1870 - DNA, 3429 bp, Artificial Sequence
  Description of Artificial Sequence: Synthetic coding sequence
atgctggtgctgagatgcagactgggcaccagcttccccaagctggacaacctggtgcccaagggcaagatgaagatcctgctggtgttcctgggcctgctgggcaacagcgtggccatgcccatgcacatgcccagaatgcccggcttcagcagcaagagcgaggagatgatgagatacaaccagttcaacttcatgaacggcccccacatggcccacctgggccccttcttcggcaacggcctgccccagcagttcccccagtaccagatgcccatgtggccccagcccccccccaacacctggcaccccagaaagagcagcgcccccaagagacacaacaagaccgaccagacccaggagacccagaagcccaaccagacccagagcaagaagcccccccagaagagacccctgaagcagcccagccacaaccagccccagcccgaggaggaggcccagcccccccaggccttcccccccttcggcaacggcctgttcccctaccagcagcccccctggcagatcccccagagactgcccccccccggctacggcagaccccccatcagcaacgaggagggcggcaacccctacttcggctacttcggctaccacggcttcggcggcagacccccctactacagcgaggagatgttcgagcaggacttcgagaagcccaaggaggaggacccccccaaggccgagagccccggcaccgagcccaccgccaacagcaccgtgaccgagaccaacagcacccagcccaaccccaagggcagccagggcggcaacgacaccagccccaccggcaacagcacccccggcctgaacaccggcaacaacccccccgcccagaacggcatcggccccctgcccgccgtgaacgccagcggccagggcggccccggcagccagatcccctggagacccagccagcccaacatcagagagaaccacccctaccccaacatcagaaacttccccagcggcagacagtggtacttcaccggcaccgtgatgggccacagacagaacagacccttctacagaaaccagcaggtgcagagaggccccagatggaacttcttcgcctgggagagaaagcaggtggccagacccggcaaccccgtgtaccacaaggcctacccccccaccagcagaggcaactaccccaactacgccggcaaccccgccaacctgagaagaaagccccagggccccaacaagcaccccgtgggcaccaccgtggcccccctgggccccaagcccggccccgtggtgagaaacgagaagatccagaaccccaaggagaagcccctgggccccaaggagcagatcatcgtgcccaccaagaaccccaccagcccctggagaaacagccagcagtacgaggtgaacaagagcaactacaagctgccccacagcgagggctacatgcccgtgcccaacttcaacagcgtggaccagcacgagaacagctactaccccagaggcgacagcagaaaggtgcccaacagcgacggccagacccagagccagaacctgcccaagggcatcgtgctgggcagcagaagaatgccctacgagagcgagaccaaccagagcgagctgaagcacagcagctaccagcccgccgtgtaccccgaggagatccccagccccgccaaggagcacttccccgccggcagaaacacctgggaccaccaggagatcagcccccccttcaaggaggaccccggcagacaggaggagcacctgccccaccccagccacggcagcagaggcagcgtgttctaccccgagtacaacccctacgaccccagagagaacagcccctacctgagaggcaacacctgggacgagagagacgacagccccaacaccatgggccagaaggagagccccctgtaccccatcaacacccccgaccagaaggagatcgtgccctacaacgaggaggaccccgtggaccccaccggcgacgaggtgttccccggccagaacagatggggcgaggagctgagcttcaagggcggccccaccgtgagacactacgagggcgagcagtacaccagcaaccagcccaaggagtacctgccctacagcctggacaaccccagcaagcccagagaggacttctactacagcgagttctacccctggagccccgacgagaacttccccagctacaacaccgccagcaccatgcccccccccatcgagagcagaggctactacgtgaacaacgccgccggccccgaggagagcaccctgttccccagcagaaacagctgggaccacagaatccaggcccagggccagagagagagaagaccctacttcaacagaaacatctgggaccaggccacccacctgcagaaggcccccgccagaccccccgaccagaagggcaaccagccctactacagcaacacccccgccggcctgcagaagaaccccatctggcacgagggcgagaacctgaactacggcatgcagatcaccagaatgaacagccccgagagagagcacagcagcttccccaacttcatcccccccagctaccccagcggccagaaggaggcccacctgttccacctgagccagagaggcagctgctgcgccggcagcagcaccggccccaaggacaaccccctggccctgcaggactacacccccagctacggcctggcccccggcgagaaccaggacaccagccccctgtacaccgacggcagccacaccaagcagaccagagacatcatcagccccaccagcatcctgcccggccagagaaacagcagcgagaagagagagagccagaaccccttcagagacgacgtgagcaccctgagaagaaacaccccctgcagcatcaagaaccagctgggccagaaggagatcatgcccttccccgaggccagcagcctgcagagcaagaacaccccctgcctgaagaacgacctgggcggcgacggcaacaacatcctggagcaggtgttcgaggacaaccagctgaacgagagaaccgtggacctgacccccgagcagctggtgatcggcacccccgacgagggcagcaaccccgagggcatccagagccaggtgcaggagaacgagagcgagagacagcagcagagacccagcaacatcctgcacctgccctgcttcggcagcaagctggccaagcaccacagcagcaccaccggcacccccagcagcgacggcagacagagccccttcgacggcgacagcatcacccccaccgagaaccccaacaccctggtggagctggccaccgaggagcagttcaagagcatcaacgtggaccccctggacgccgacgagcacagccccttcgagttcctgcagagaggcaccaacgtgcaggaccaggtgcaggactgcctgctgctgcaggcctag

SEQ ID NO: 1871 - DNA, 582 bp, Artificial Sequence
  Description of Artificial Sequence: Synthetic coding sequence
atgggcgtgcacgagtgccccgcctggctgtggctgctgctgagcctgctgagcctgcccctgggcctgcccgtgctgggcgccccccccagactgatctgcgacagcagagtgctggagagatacctgctggaggccaaggaggccgagaacatcaccaccggctgcgccgagcactgcagcctgaacgagaacatcaccgtgcccgacaccaaggtgaacttctacgcctggaagagaatggaggtgggccagcaggccgtggaggtgtggcagggcctggccctgctgagcgaggccgtgctgagaggccaggccctgctggtgaacagcagccagccctgggagcccctgcagctgcacgtggacaaggccgtgagcggcctgagaagcctgaccaccctgctgagagccctgggcgcccagaaggaggccatcagcccccccgacgccgccagcgccgcccccctgagaaccatcaccgccgacaccttcagaaagctgttcagagtgtacagcaacttcctgagaggcaagctgaagctgtacaccggcgaggcctgcagaaccggcgacagatag

SEQ ID NO: 1872 - DNA, 192 bp, Artificial Sequence
  Description of Artificial Sequence: Synthetic coding sequence
atgcccagcagcgtgagctggggcatcctgctgctggccggcctgtgctgcctggtgcccgtgagcctggcccacggcgagggcaccttcaccagcgacctgagcaagcagatggaggaggaggccgtgagactgttcatcgagtggctgaagaacggcggccccagcagcggcgcccccccccccagctag

SEQ ID NO: 1873 - DNA, 1050 bp, Artificial Sequence
  Description of Artificial Sequence: Synthetic coding sequence
atggaggccgtgaaggccgaggcctgggagggcgccgccgtggcccaggacctgctggccctgggctacggcggcgtgcccggcgccgccagcagaggcgccagctgccccgacttcagaggcctgtgcgtgagactggccgccgagctggccaccctgggcgccctggagcagcagagagaggccggcgccgaggtgctgagcgccggcgacggccccggcgccgaggaggacttcctgagacagctgggcagcctgctgagagagctgcactgccccgacagagccctgtgcggcggcgacggcgccgccgccctgagagagcccggcgccggcctgagactgctgagattcctgtgcagcgagctgcaggccaccagactgctgtgcctgagaagcctgctggaccccagccccagaccccccctgggcgagggcgtggtggagggcgccggcatggtgcaggagctggacctgaccctgcaggccctgggcctgcccagacccgcccccggcacccccgccagccagctgctgcaggagctgcacgccaagatcagcgagctgcagcccagcctgccccccggcagcctgcagcccctgctgagctgcagcctggacgcccccagatgggaggccctggagagcctgagccagagcctgagagaccagtacagatgcagaagatgcctgctgctgaagagactggacctgaccaccagcgccttccactggagcgacagagccgaggcccagggcgaggccatgagagccgtgctgatccccatcagagaggtgctgacccccgagagcgacatcagcatcgcccacgtgctggccgccagagccgacctgagctgcctggtgcccgccaccagcgtggccgtgagaagaggcacctgctgcgccatcaacaaggtgctgatgggcaacgtgcccgacagaggcggcagacccaacgagctggagccccccatgcccacctggagaagcagaagagaggacggcggcccccagtgctggggcagaaagaagaagaagaagaagtag

SEQ ID NO: 1874 - DNA, 804 bp, Artificial Sequence
  Description of Artificial Sequence: Synthetic coding sequence
atggaggccgtgaaggccgaggcctgggagggcgccgccgtggcccaggacctgctggccctgggctacggcggcgtgcccggcgccgccagcagaggcgccagctgccccgacttcagaggcctgtgcgtgagactggccgccgagctggccaccctgggcgccctggagcagcagagagaggccggcgccgaggtgctgagcgccggcgacggccccggcgccgaggaggacttcctgagacagctgggcagcctgctgagagagctgcactgccccgacagagccctgtgcggcggcgacggcgccgccgccctgagagagcccggcgccggcctgagactgctgagattcctgtgcagcgagctgcaggccaccagactgctgtgcctgagaagcctgctggaccccagccccagaccccccctgggcgagggcgtggtggagggcgccggcatggtgcaggagctggacctgaccctgcaggccctgggcctgcccagacccgcccccggcacccccgccagccagctgctgcaggagctgcacgccaaggaggccctggagagcctgagccagagcctgagagaccagtacagatgcagaagatgcctgctgctgaagagactggacctgaccaccagcgccttccactggagcgacagagccgaggtgctgatgggcaacgtgcccgacagaggcggcagacccaacgagctggagccccccatgcccacctggagaagcagaagagaggacggcggcccccagtgctggggcagaaagaagaagaagaagaagtag

SEQ ID NO: 1875 - DNA, 2601 bp, Artificial Sequence
  Description of Artificial Sequence: Synthetic coding sequence
atgttcagcatgagaatcgtgtgcctggtgctgagcgtggtgggcaccgcctggaccgccgacagcggcgagggcgacttcctggccgagggcggcggcgtgagaggccccagagtggtggagagacaccagagcgcctgcaaggacagcgactggcccttctgcagcgacgaggactggaactacaagtgccccagcggctgcagaatgaagggcctgatcgacgaggtgaaccaggacttcaccaacagaatcaacaagctgaagaacagcctgttcgagtaccagaagaacaacaaggacagccacagcctgaccaccaacatcatggagatcctgagaggcgacttcagcagcgccaacaacagagacaacacctacaacagagtgagcgaggacctgagaagcagaatcgaggtgctgaagagaaaggtgatcgagaaggtgcagcacatccagctgctgcagaagaacgtgagagcccagctggtggacatgaagagactggaggtggacatcgacatcaagatcagaagctgcagaggcagctgcagcagagccctggccagagaggtggacctgaaggactacgaggaccagcagaagcagctggagcaggtgatcgccaaggacctgctgcccagcagagacagacagcacctgcccctgatcaagatgaagcccgtgcccgacctggtgcccggcaacttcaagagccagctgcagaaggtgccccccgagtggaaggccctgaccgacatgccccagatgagaatggagctggagagacccggcggcaacgagatcaccagaggcggcagcaccagctacggcaccggcagcgagaccgagagccccagaaaccccagcagcgccggcagctggaacagcggcagcagcggccccggcagcaccggcaacagaaaccccggcagcagcggcaccggcggcaccgccacctggaagcccggcagcagcggccccggcagcaccggcagctggaacagcggcagcagcggcaccggcagcaccggcaaccagaaccccggcagccccagacccggcagcaccggcacctggaaccccggcagcagcgagagaggcagcgccggccactggaccagcgagagcagcgtgagcggcagcaccggccagtggcacagcgagagcggcagcttcagacccgacagccccggcagcggcaacgccagacccaacaaccccgactggggcaccttcgaggaggtgagcggcaacgtgagccccggcaccagaagagagtaccacaccgagaagctggtgaccagcaagggcgacaaggagctgagaaccggcaaggagaaggtgaccagcggcagcaccaccaccaccagaagaagctgcagcaagaccgtgaccaagaccgtgatcggccccgacggccacaaggaggtgaccaaggaggtggtgaccagcgaggacggcagcgactgccccgaggccatggacctgggcaccctgagcggcatcggcaccctggacggcttcagacacagacaccccgacgaggccgccttcttcgacaccgccagcaccggcaagaccttccccggcttcttcagccccatgctgggcgagttcgtgagcgagaccgagagcagaggcagcgagagcggcatcttcaccaacaccaaggagagcagcagccaccaccccggcatcgccgagttccccagcagaggcaagagcagcagctacagcaagcagttcaccagcagcaccagctacaacagaggcgacagcaccttcgagagcaagagctacaagatggccgacgaggccggcagcgaggccgaccacgagggcacccacagcaccaagagaggccacgccaagagcagacccgtgagagactgcgacgacgtgctgcagacccaccccagcggcacccagagcggcatcttcaacatcaagctgcccggcagcagcaagatcttcagcgtgtactgcgaccaggagaccagcctgggcggctggctgctgatccagcagagaatggacggcagcctgaacttcaacagaacctggcaggactacaagagaggcttcggcagcctgaacgacgagggcgagggcgagttctggctgggcaacgactacctgcacctgctgacccagagaggcagcgtgctgagagtggagctggaggactgggccggcaacgaggcctacgccgagtaccacttcagagtgggcagcgaggccgagggctacgccctgcaggtgagcagctacgagggcaccgccggcgacgccctgatcgagggcagcgtggaggagggcgccgagtacaccagccacaacaacatgcagttcagcaccttcgacagagacgccgaccagtgggaggagaactgcgccgaggtgtacggcggcggctggtggtacaacaactgccaggccgccaacctgaacggcatctactaccccggcggcagctacgaccccagaaacaacagcccctacgagatcgagaacggcgtggtgtgggtgagcttcagaggcgccgactacagcctgagagccgtgagaatgaagatcagacccctggtgacccagtag

SEQ ID NO: 1876 - DNA, 1935 bp, Artificial Sequence
  Description of Artificial Sequence: Synthetic coding sequence
atgttcagcatgagaatcgtgtgcctggtgctgagcgtggtgggcaccgcctggaccgccgacagcggcgagggcgacttcctggccgagggcggcggcgtgagaggccccagagtggtggagagacaccagagcgcctgcaaggacagcgactggcccttctgcagcgacgaggactggaactacaagtgccccagcggctgcagaatgaagggcctgatcgacgaggtgaaccaggacttcaccaacagaatcaacaagctgaagaacagcctgttcgagtaccagaagaacaacaaggacagccacagcctgaccaccaacatcatggagatcctgagaggcgacttcagcagcgccaacaacagagacaacacctacaacagagtgagcgaggacctgagaagcagaatcgaggtgctgaagagaaaggtgatcgagaaggtgcagcacatccagctgctgcagaagaacgtgagagcccagctggtggacatgaagagactggaggtggacatcgacatcaagatcagaagctgcagaggcagctgcagcagagccctggccagagaggtggacctgaaggactacgaggaccagcagaagcagctggagcaggtgatcgccaaggacctgctgcccagcagagacagacagcacctgcccctgatcaagatgaagcccgtgcccgacctggtgcccggcaacttcaagagccagctgcagaaggtgccccccgagtggaaggccctgaccgacatgccccagatgagaatggagctggagagacccggcggcaacgagatcaccagaggcggcagcaccagctacggcaccggcagcgagaccgagagccccagaaaccccagcagcgccggcagctggaacagcggcagcagcggccccggcagcaccggcaacagaaaccccggcagcagcggcaccggcggcaccgccacctggaagcccggcagcagcggccccggcagcaccggcagctggaacagcggcagcagcggcaccggcagcaccggcaaccagaaccccggcagccccagacccggcagcaccggcacctggaaccccggcagcagcgagagaggcagcgccggccactggaccagcgagagcagcgtgagcggcagcaccggccagtggcacagcgagagcggcagcttcagacccgacagccccggcagcggcaacgccagacccaacaaccccgactggggcaccttcgaggaggtgagcggcaacgtgagccccggcaccagaagagagtaccacaccgagaagctggtgaccagcaagggcgacaaggagctgagaaccggcaaggagaaggtgaccagcggcagcaccaccaccaccagaagaagctgcagcaagaccgtgaccaagaccgtgatcggccccgacggccacaaggaggtgaccaaggaggtggtgaccagcgaggacggcagcgactgccccgaggccatggacctgggcaccctgagcggcatcggcaccctggacggcttcagacacagacaccccgacgaggccgccttcttcgacaccgccagcaccggcaagaccttccccggcttcttcagccccatgctgggcgagttcgtgagcgagaccgagagcagaggcagcgagagcggcatcttcaccaacaccaaggagagcagcagccaccaccccggcatcgccgagttccccagcagaggcaagagcagcagctacagcaagcagttcaccagcagcaccagctacaacagaggcgacagcaccttcgagagcaagagctacaagatggccgacgaggccggcagcgaggccgaccacgagggcacccacagcaccaagagaggccacgccaagagcagacccgtgagaggcatccacaccagccccctgggcaagcccagcctgagcccctag

SEQ ID NO: 1877 - DNA, 870 bp, Artificial Sequence
  Description of Artificial Sequence: Synthetic coding sequence
atgttcagcatgagaatcgtgtgcctggtgctgagcgtggtgggcaccgcctggaccgccgacagcggcgagggcgacttcctggccgagggcggcggcgtgagaggccccagagtggtggagagacaccagagcgcctgcaaggacagcgactggcccttctgcagcgacgaggactggaactacaagtgccccagcggctgcagaatgaagggcctgatcgacgaggtgaaccaggacttcaccaacagaatcaacaagctgaagaacagcctgttcgagtaccagaagaacaacaaggacagccacagcctgaccaccaacatcatggagatcctgagaggcgacttcagcagcgccaacaacagagacaacacctacaacagagtgagcgaggacctgagaagcagaatcgaggtgctgaagagaaaggtgatcgagaaggtgcagcacatccagctgctgcagaagaacgtgagagcccagctggtggacatgaagagactggaggtggacatcgacatcaagatcagaagctgcagaggcagctgcagcagagccctggccagagaggtggacctgaaggactacgaggaccagcagaagcagctggagcaggtgatcgccaaggacctgctgcccgtggtgaacctgcaggtgaccgccaacaacctgctggtggccagagtgaccaccgaggagaccccccacctgaaggccagagccatcaagtggcagatgagacccgaggtgaagcccatcatgaaggagcacatcgcccccagagaggccatgctgaacctggccctgagcgaggtgagcaccctgctgctgtggggcagcctgccctgcccccccagactgagctag

SEQ ID NO: 1878 - DNA, 1476 bp, Artificial Sequence
  Description of Artificial Sequence: Synthetic coding sequence
atgaagagaatggtgagctggagcttccacaagctgaagaccatgaagcacctgctgctgctgctgctgtgcgtgttcctggtgaagagccagggcgtgaacgacaacgaggagggcttcttcagcgccagaggccacagacccctggacaagaagagagaggaggcccccagcctgagacccgcccccccccccatcagcggcggcggctacagagccagacccgccaaggccgccgccacccagaagaaggtggagagaaaggcccccgacgccggcggctgcctgcacgccgaccccgacctgggcgtgctgtgccccaccggctgccagctgcaggaggccctgctgcagcaggagagacccatcagaaacagcgtggacgagctgaacaacaacgtggaggccgtgagccagaccagcagcagcagcttccagtacatgtacctgctgaaggacctgtggcagaagagacagaagcaggtgaaggacaacgagaacgtggtgaacgagtacagcagcgagctggagaagcaccagctgtacatcgacgagaccgtgaacagcaacatccccaccaacctgagagtgctgagaagcatcctggagaacctgagaagcaagatccagaagctggagagcgacgtgagcgcccagatggagtactgcagaaccccctgcaccgtgagctgcaacatccccgtggtgagcggcaaggagtgcgaggagatcatcagaaagggcggcgagaccagcgagatgtacctgatccagcccgacagcagcgtgaagccctacagagtgtactgcgacatgaacaccgagaacggcggctggaccgtgatccagaacagacaggacggcagcgtggacttcggcagaaagtgggacccctacaagcagggcttcggcaacgtggccaccaacaccgacggcaagaactactgcggcctgcccggcgagtactggctgggcaacgacaagatcagccagctgaccagaatgggccccaccgagctgctgatcgagatggaggactggaagggcgacaaggtgaaggcccactacggcggcttcaccgtgcagaacgaggccaacaagtaccagatcagcgtgaacaagtacagaggcaccgccggcaacgccctgatggacggcgccagccagctgatgggcgagaacagaaccatgaccatccacaacggcatgttcttcagcacctacgacagagacaacgacggctggctgaccagcgaccccagaaagcagtgcagcaaggaggacggcggcggctggtggtacaacagatgccacgccgccaaccccaacggcagatactactggggcggccagtacacctgggacatggccaagcacggcaccgacgacggcgtggtgtggatgaactggaagggcagctggtacagcatgagaaagatgagcatgaagatcagacccttcttcccccagcagtag

SEQ ID NO: 1879 - DNA, 1425 bp, Artificial Sequence
  Description of Artificial Sequence: Synthetic coding sequence
atgaagagaatggtgagctggagcttccacaagctgaagaccatgaagcacctgctgctgctgctgctgtgcgtgttcctggtgaagagccagggcgtgaacgacaacgaggagggcttcttcagcgccagaggccacagacccctggacaagaagagagaggaggccagacccgccaaggccgccgccacccagaagaaggtggagagaaaggcccccgacgccggcggctgcctgcacgccgaccccgacctgggcgtgctgtgccccaccggctgccagctgcaggaggccctgctgcagcaggagagacccatcagaaacagcgtggacgagctgaacaacaacgtggaggccgtgagccagaccagcagcagcagcttccagtacatgtacctgctgaaggacctgtggcagaagagacagaagcaggtgaaggacaacgagaacgtggtgaacgagtacagcagcgagctggagaagcaccagctgtacatcgacgagaccgtgaacagcaacatccccaccaacctgagagtgctgagaagcatcctggagaacctgagaagcaagatccagaagctggagagcgacgtgagcgcccagatggagtactgcagaaccccctgcaccgtgagctgcaacatccccgtggtgagcggcaaggagtgcgaggagatcatcagaaagggcggcgagaccagcgagatgtacctgatccagcccgacagcagcgtgaagccctacagagtgtactgcgacatgaacaccgagaacggcggctggaccgtgatccagaacagacaggacggcagcgtggacttcggcagaaagtgggacccctacaagcagggcttcggcaacgtggccaccaacaccgacggcaagaactactgcggcctgcccggcgagtactggctgggcaacgacaagatcagccagctgaccagaatgggccccaccgagctgctgatcgagatggaggactggaagggcgacaaggtgaaggcccactacggcggcttcaccgtgcagaacgaggccaacaagtaccagatcagcgtgaacaagtacagaggcaccgccggcaacgccctgatggacggcgccagccagctgatgggcgagaacagaaccatgaccatccacaacggcatgttcttcagcacctacgacagagacaacgacggctggctgaccagcgaccccagaaagcagtgcagcaaggaggacggcggcggctggtggtacaacagatgccacgccgccaaccccaacggcagatactactggggcggccagtacacctgggacatggccaagcacggcaccgacgacggcgtggtgtggatgaactggaagggcagctggtacagcatgagaaagatgagcatgaagatcagacccttcttcccccagcagtag

SEQ ID NO: 1880 - DNA, 1362 bp, Artificial Sequence
  Description of Artificial Sequence: Synthetic coding sequence
atgagctggagcctgcaccccagaaacctgatcctgtacttctacgccctgctgttcctgagcagcacctgcgtggcctacgtggccaccagagacaactgctgcatcctggacgagagattcggcagctactgccccaccacctgcggcatcgccgacttcctgagcacctaccagaccaaggtggacaaggacctgcagagcctggaggacatcctgcaccaggtggagaacaagaccagcgaggtgaagcagctgatcaaggccatccagctgacctacaaccccgacgagagcagcaagcccaacatgatcgacgccgccaccctgaagagcagaaagatgctggaggagatcatgaagtacgaggccagcatcctgacccacgacagcagcatcagatacctgcaggagatctacaacagcaacaaccagaagatcgtgaacctgaaggagaaggtggcccagctggaggcccagtgccaggagccctgcaaggacaccgtgcagatccacgacatcaccggcaaggactgccaggacatcgccaacaagggcgccaagcagagcggcctgtacttcatcaagcccctgaaggccaaccagcagttcctggtgtactgcgagatcgacggcagcggcaacggctggaccgtgttccagaagagactggacggcagcgtggacttcaagaagaactggatccagtacaaggagggcttcggccacctgagccccaccggcaccaccgagttctggctgggcaacgagaagatccacctgatcagcacccagagcgccatcccctacgccctgagagtggagctggaggactggaacggcagaaccagcaccgccgactacgccatgttcaaggtgggccccgaggccgacaagtacagactgacctacgcctacttcgccggcggcgacgccggcgacgccttcgacggcttcgacttcggcgacgaccccagcgacaagttcttcaccagccacaacggcatgcagttcagcacctgggacaacgacaacgacaagttcgagggcaactgcgccgagcaggacggcagcggctggtggatgaacaagtgccacgccggccacctgaacggcgtgtactaccagggcggcacctacagcaaggccagcacccccaacggctacgacaacggcatcatctgggccacctggaagaccagatggtacagcatgaagaagaccaccatgaagatcatccccttcaacagactgaccatcggcgagggccagcagcaccacctgggcggcgccaagcaggtgagacccgagcaccccgccgagaccgagtacgacagcctgtaccccgaggacgacctgtag

SEQ ID NO: 1881 - DNA, 1314 bp, Artificial Sequence
  Description of Artificial Sequence: Synthetic coding sequence
atgagctggagcctgcaccccagaaacctgatcctgtacttctacgccctgctgttcctgagcagcacctgcgtggcctacgtggccaccagagacaactgctgcatcctggacgagagattcggcagctactgccccaccacctgcggcatcgccgacttcctgagcacctaccagaccaaggtggacaaggacctgcagagcctggaggacatcctgcaccaggtggagaacaagaccagcgaggtgaagcagctgatcaaggccatccagctgacctacaaccccgacgagagcagcaagcccaacatgatcgacgccgccaccctgaagagcagaaagatgctggaggagatcatgaagtacgaggccagcatcctgacccacgacagcagcatcagatacctgcaggagatctacaacagcaacaaccagaagatcgtgaacctgaaggagaaggtggcccagctggaggcccagtgccaggagccctgcaaggacaccgtgcagatccacgacatcaccggcaaggactgccaggacatcgccaacaagggcgccaagcagagcggcctgtacttcatcaagcccctgaaggccaaccagcagttcctggtgtactgcgagatcgacggcagcggcaacggctggaccgtgttccagaagagactggacggcagcgtggacttcaagaagaactggatccagtacaaggagggcttcggccacctgagccccaccggcaccaccgagttctggctgggcaacgagaagatccacctgatcagcacccagagcgccatcccctacgccctgagagtggagctggaggactggaacggcagaaccagcaccgccgactacgccatgttcaaggtgggccccgaggccgacaagtacagactgacctacgcctacttcgccggcggcgacgccggcgacgccttcgacggcttcgacttcggcgacgaccccagcgacaagttcttcaccagccacaacggcatgcagttcagcacctgggacaacgacaacgacaagttcgagggcaactgcgccgagcaggacggcagcggctggtggatgaacaagtgccacgccggccacctgaacggcgtgtactaccagggcggcacctacagcaaggccagcacccccaacggctacgacaacggcatcatctgggccacctggaagaccagatggtacagcatgaagaagaccaccatgaagatcatccccttcaacagactgaccatcggcgagggccagcagcaccacctgggcggcgccaagcaggccggcgacgtgtag

SEQ ID NO: 1882 - DNA, 2892 bp, Artificial Sequence
  Description of Artificial Sequence: Synthetic coding sequence
atgctgagcggcgagagaaaggagggcggcagccccagattcggcaagctgcacctgcccgtgggcctgtggatcaacagccccagaaagcagctggccaagctgggcagaagatggcccagcgccgccagcgtgaagagcagcagcagcgacaccggcagcagaagcagcgagcccctgccccccccccccccccacgtggagctgagaagagtgggcgccgtgaaggccgccggcggcgccagcggcagcagagccaagagaatcagccagctgttcagaggcagcggcaccggcaccaccggcagcagcggcgccggcggccccggcacccccggcggcgcccagagatgggccagcgagaagaagctgcccgagctggccgccggcgtggcccccgagccccccctggccaccagagccaccgccccccccggcgtgctgaagatcttcggcgccggcctggccagcggcgccaactacaagagcgtgctggccaccgccagaagcaccgccagagagctggtggccgaggccctggagagatacggcctggccggcagccccggcggcggccccggcgagagcagctgcgtggacgccttcgccctgtgcgacgccctgggcagacccgccgccgccggcgtgggcagcggcgagtggagagccgagcacctgagagtgctgggcgacagcgagagacccctgctggtgcaggagctgtggagagccagacccggctgggccagaagattcgagctgagaggcagagaggaggccagaagactggagcaggaggccttcggcgccgccgacagcgagggcaccggcgcccccagctggagaccccagaagaacagaagcagagccgccagcggcggcgccgccctggccagccccggccccggcaccggcagcggcgcccccgccggcagcggcggcaaggagagaagcgagaacctgagcctgagaagaagcgtgagcgagctgagcctgcagggcagaagaagaagacagcaggagagaagacagcaggccctgagcatggcccccggcgccgccgacgcccagatcggcaccgccgaccccggcgacttcgaccagctgacccagtgcctgatccaggcccccagcaacagaccctacttcctgctgctgcagggctaccaggacgcccaggacttcgtggtgtacgtgatgaccagagagcagcacgtgttcggcagaggcggcaacagcagcggcagaggcggcagccccgccccctacgtggacaccttcctgaacgcccccgacatcctgcccagacactgcaccgtgagagccggccccgagcaccccgccatggtgagacccagcagaggcgcccccgtgacccacaacggctgcctgctgctgagagaggccgagctgcaccccggcgacctgctgggcctgggcgagcacttcctgttcatgtacaaggaccccagaaccggcggcagcggccccgccagacccccctggctgcccgccagacccggcgccaccccccccggccccggctgggccttcagctgcagactgtgcggcagaggcctgcaggagagaggcgaggccctggccgcctacctggacggcagagagcccgtgctgagattcagacccagagaggaggaggccctgctgggcgagatcgtgagagccgccgccgccggcagcggcgacctgccccccctgggccccgccaccctgctggccctgtgcgtgcagcacagcgccagagagctggagctgggccacctgcccagactgctgggcagactggccagactgatcaaggaggccgtgtgggagaagatcaaggagatcggcgacagacagcccgagaaccaccccgagggcgtgcccgaggtgcccctgacccccgaggccgtgagcgtggagctgagacccctgatgctgtggatggccaacaccaccgagctgctgagcttcgtgcaggagaaggtgctggagatggagaaggaggccgaccaggaggacccccagctgtgcaacgacctggagctgtgcgacgaggccatggccctgctggacgaggtgatcatgtgcaccttccagcagagcgtgtactacctgaccaagaccctgtacagcaccctgcccgccctgctggacagcaaccccttcaccgccggcgccgagctgcccggccccggcgccgagctgggcgccatgccccccggcctgagacccaccctgggcgtgttccaggccgccctggagctgaccagccagtgcgagctgcaccccgacctggtgagccagaccttcggctacctgttcttcttcagcaacgccagcctgctgaacagcctgatggagagaggccagggcagacccttctaccagtggagcagagccgtgcagatcagaaccaacctggacctggtgctggactggctgcagggcgccggcctgggcgacatcgccaccgagttcttcagaaagctgagcatggccgtgaacctgctgtgcgtgcccagaaccagcctgctgaaggccagctggagcagcctgagaaccgaccaccccaccctgacccccgcccagctgcaccacctgctgagccactaccagctgggccccggcagaggcccccccgccgcctgggaccccccccccgccgagagagaggccgtggacaccggcgacatcttcgagagcttcagcagccacccccccctgatcctgcccctgggcagcagcagactgagactgaccggccccgtgaccgacgacgccctgcacagagagctgagaagactgagaagactgctgtgggacctggagcagcaggagctgcccgccaactacagacacggcccccccgtggccaccagcccctag

SEQ ID NO: 1883 - DNA, 630 bp, Artificial Sequence
  Description of Artificial Sequence: Synthetic coding sequence
atggacagcgacgagaccggcttcgagcacagcggcctgtgggtgagcgtgctggccggcctgctgctgggcgcctgccaggcccaccccatccccgacagcagccccctgctgcagttcggcggccaggtgagacagagatacctgtacaccgacgacgcccagcagaccgaggcccacctggagatcagagaggacggcaccgtgggcggcgccgccgaccagagccccgagagcctgctgcagctgaaggccctgaagcccggcgtgatccagatcctgggcgtgaagaccagcagattcctgtgccagagacccgacggcgccctgtacggcagcctgcacttcgaccccgaggcctgcagcttcagagagctgctgctggaggacggctacaacgtgtaccagagcgaggcccacggcctgcccctgcacctgcccggcaacaagagcccccacagagaccccgcccccagaggccccgccagattcctgcccctgcccggcctgccccccgccctgcccgagccccccggcatcctggccccccagccccccgacgtgggcagcagcgaccccctgagcatggtgggccccagccagggcagaagccccagctacgccagctag

SEQ ID NO: 1884 - DNA, 321 bp, Artificial Sequence
  Description of Artificial Sequence: Synthetic coding sequence
atgctgagattcatccaggaggtgaacaccaccaccagaagctgcgccctgtgggacctggaggaggacaccgagtacatcgtgcacgtgcaggccatcagcatccagggccagagccccgccagcgagcccgtgctgttcaagacccccagagaggccgagaagatggccagcaagaacaaggacgaggtgaccatgaaggagatgggcagaaaccagcagctgagaaccggcgaggtgctgatcatcgtggtggtgctgttcatgtgggccggcgtgatcgccctgttctgcagacagtacgacatcatcgaggcctag

SEQ ID NO: 1885 - DNA, 414 bp, Artificial Sequence
  Description of Artificial Sequence: Synthetic coding sequence
atgctgagattcatccaggaggtgaacaccaccaccagaagctgcgccctgtgggacctggaggaggacaccgagtacatcgtgcacgtgcaggccatcagcatccagggccagagccccgccagcgagcccgtgctgttcaagacccccagagaggccgagaagatggccagcaagaacaaggacgaggtgaccatgaaggagatgggcagaaaccagcagctgagaaccggcgaggtgctgatcatcgtggtggtgctgttcatgtgggccggcgtgatcgccctgttctgcagacagtacgacatcatcaaggacaacgagcccaacaacaacaaggagaagaccaagagcgccagcgagaccagcacccccgagcaccagggcggcggcctgctgagaagcaagatctag

SEQ ID NO: 1886 - DNA, 390 bp, Artificial Sequence
  Description of Artificial Sequence: Synthetic coding sequence
atgaagaccctgcagttcttcttcctgttctgctgctggaaggccatctgctgcaacagctgcgagctgaccaacatcaccatcgccatcgagaaggaggagtgcagattctgcatcagcatcaacaccacctggtgcgccggctactgctacaccagagacctggtgtacaaggaccccgccagacccaagatccagaagacctgcaccttcaaggagctggtgtacgagaccgtgagagtgcccggctgcgcccaccacgccgacagcctgtacacctaccccgtggccacccagtgccactgcggcaagtgcgacagcgacagcaccgactgcaccgtgagaggcctgggccccagctactgcagcttcggcgagatgaaggagtag

SEQ ID NO: 1887 - DNA, 390 bp, Artificial Sequence; identical to SEQ ID NO: 1886
  Description of Artificial Sequence: Synthetic coding sequence

SEQ ID NO: 1888 - DNA, 390 bp, Artificial Sequence; identical to SEQ ID NO: 1886
  Description of Artificial Sequence: Synthetic coding sequence

SEQ ID NO: 1889 - DNA, 1260 bp, Artificial Sequence
  Description of Artificial Sequence: Synthetic coding sequence
atgagcttcatccccgtggccgaggacagcgacttccccatccacaacctgccctacggcgtgttcagcaccagaggcgaccccagacccagaatcggcgtggccatcggcgaccagatcctggacctgagcatcatcaagcacctgttcaccggccccgtgctgagcaagcaccaggacgtgttcaaccagcccaccctgaacagcttcatgggcctgggccaggccgcctggaaggaggccagagtgttcctgcagaacctgctgagcgtgagccaggccagactgagagacgacaccgagctgagaaagtgcgccttcatcagccaggccagcgccaccatgcacctgcccgccaccatcggcgactacaccgacttctacagcagcagacagcacgccaccaacgtgggcatcatgttcagagacaaggagaacgccctgatgcccaactggctgcacctgcccgtgggctaccacggcagagccagcagcgtggtggtgagcggcacccccatcagaagacccatgggccagatgaagcccgacgacagcaagccccccgtgtacggcgcctgcaagctgctggacatggagctggagatggccttcttcgtgggccccggcaacagactgggcgagcccatccccatcagcaaggcccacgagcacatcttcggcatggtgctgatgaacgactggagcgccagagacatccagaagtgggagtacgtgcccctgggccccttcctgggcaagagcttcggcaccaccgtgagcccctgggtggtgcccatggacgccctgatgcccttcgccgtgcccaaccccaagcaggaccccagacccctgccctacctgtgccacgacgagccctacaccttcgacatcaacctgagcgtgaacctgaagggcgagggcatgagccaggccgccaccatctgcaagagcaacttcaagtacatgtactggaccatgctgcagcagctgacccaccacagcgtgaacggctgcaacctgagacccggcgacctgctggccagcggcaccatcagcggccccgagcccgagaacttcggcagcatgctggagctgagctggaagggcaccaagcccatcgacctgggcaacggccagaccagaaagttcctgctggacggcgacgaggtgatcatcaccggctactgccagggcgacggctacagaatcggcttcggccagtgcgccggcaaggtgctgcccgccctgctgcccagctag

SEQ ID NO: 1890 - DNA, 1260 bp, Artificial Sequence; identical to SEQ ID NO: 1889
  Description of Artificial Sequence: Synthetic coding sequence

SEQ ID NO: 1891 - DNA, 1260 bp, Artificial Sequence; identical to SEQ ID NO: 1889
  Description of Artificial Sequence: Synthetic coding sequence

SEQ ID NO: 1892 - DNA, 759 bp, Artificial Sequence
  Description of Artificial Sequence: Synthetic coding sequence
atggaggccatgtggctgctgtgcgtggccctggccgtgctggcctggggcttcctgtgggtgtgggacagcagcgagagaatgaagagcagagagcagggcggcagactgggcgccgagagcagaaccctgctggtgatcgcccaccccgacgacgaggccatgttcttcgcccccaccgtgctgggcctggccagactgagacactgggtgtacctgctgtgcttcagcgccggcaactactacaaccagggcgagaccagaaagaaggagctgctgcagagctgcgacgtgctgggcatccccctgagcagcgtgatgatcatcgacaacagagacttccccgacgaccccggcatgcagtgggacaccgagcacgtggccagagtgctgctgcagcacatcgaggtgaacggcatcaacctggtggtgaccttcgacgccggcggcgtgagcggccacagcaaccacatcgccctgtacgccgccgtgagagccctgcacagcgagggcaagctgcccaagggctgcagcgtgctgaccctgcagagcgtgaacgtgctgagaaagtacatcagcctgctggacctgcccctgagcctgctgcacacccaggacgtgctgttcgtgctgaacagcaaggaggtggcccaggccaagaaggccatgagctgccacagaagccagctgctgtggttcagaagactgtacatcatcttcagcagatacatgagaatcaacagcctgagcttcctgtag

SEQ ID NO: 1893 - DNA, 1203 bp, Artificial Sequence
  Description of Artificial Sequence: Synthetic coding sequence
atggccgccctgagacagccccaggtggccgagctgctggccgaggccagaagagccttcagagaggagttcggcgccgagcccgagctggccgtgagcgcccccggcagagtgaacctgatcggcgagcacaccgactacaaccagggcctggtgctgcccatgagagacagactgttccccaccctggagggcagaaagagaggcagcggcagagagagagtgagaggcagactgctggcccaggccagacccctgggcgccggcgcccccagactgcagcccggcagcatgttccccctgaactgcgaggccctgtgcgccacccagaagggcaccctgagagccagcggccacagaggcgcccccaccgccgacctgggcgagagaagcctgctggcccagcccgtgcagttcaccgaggaggagaccggcggcgccttcagacccatctgcagcctgggcagcgcccaggccagcagccccccctgccccaccgcccagggcagagtgcaggacggcctggtgagcctgctgaccaccagcgagggcgccgacgagccccagagactgcagttccccctgcccaccgcccagagaagcctggagcccggcacccccagatgggccaactacgtgaagggcgtgatccagtactaccccgccgcccccctgcccggcttcagcgccgtggtggtgagcagcgtgcccctgggcggcggcctgagcagcagcgccagcctggaggtggccacctacaccttcctgcagcagctgtgccccgacagcggcaccatcgccgccagagcccaggtgtgccagcaggccgagcacagcttcgccggcatgccctgcggcatcatggaccagttcatcagcctgatgggccagaagggccacgccctgctgatcgactgcagaagcctggagaccagcctggtgcccctgagcgaccccaagctggccgtgctgatcaccaacagcaacgtgagacacagcctggccagcagcgagtaccccgtgagaagaagacagtgcgaggaggtggccagagccctgggcaaggagagcctgagagaggtgcagctggaggagctggaggccgccagagacctggtgagcaaggagggcttcagaagagccagacacgtggtgggcgagatcagaagaaccgccgacggcgccaaggtgctgtgcctgtag

SEQ ID NO: 1894 - DNA, 1269 bp, Artificial Sequence
  Description of Artificial Sequence: Synthetic coding sequence
atgtgcgccccccccagaggcgccccccccgagcaccccgcccccaccggcctgtgcagaagcagctgcgccgagctgcaggccagagtgatggccgccctgagacagccccaggtggccgagctgctggccgaggccagaagagccttcagagaggagttcggcgccgagcccgagctggccgtgagcgcccccggcagagtgaacctgatcggcgagcacaccgactacaaccagggcctggtgctgcccatggccctggagctgatgaccgtgctggtgggcagccccagaaaggacggcctggtgagcctgctgaccaccagcgagggcgccgacgagccccagagactgcagttccccctgcccaccgcccagagaagcctggagcccggcacccccagatgggccaactacgtgaagggcgtgatccagtactaccccgccgcccccctgcccggcttcagcgccgtggtggtgagcagcgtgcccctgggcggcggcctgagcagcagcgccagcctggaggtggccacctacaccttcctgcagcagctgtgccccgacagcggcaccatcgccgccagagcccaggtgtgccagcaggccgagcacagcttcgccggcatgccctgcggcatcatggaccagttcatcagcctgatgggccagaagggccacgccctgctgatcgactgcagaagcctggagaccagcctggtgcccctgagcgaccccaagctggccgtgctgatcaccaacagcaacgtgagacacagcctggccagcagcgagtaccccgtgagaagaagacagtgcgaggaggtggccagagccctgggcaaggagagcctgagagaggtgcagctggaggagctggaggccgccagagacctggtgagcaaggagggcttcagaagagccagacacgtggtgggcgagatcagaagaaccgcccaggccgccgccgccctgagaagaggcgactacagagccttcggcagactgatggtggagagccacagaagcctgagagacgactacgaggtgagctgccccgagctggaccagctggtggaggccgccctggccgtgcccggcgtgtacggcagcagaatgaccggcggcggcttcggcggctgcaccgtgaccctgctggaggccagcgccgccccccacgccatgagacacatccaggagcactacggcggcaccgccaccttctacctgagccaggccgccgacggcgccaaggtgctgtgcctgtag

SEQ ID NO: 1895 - DNA, 1179 bp, Artificial Sequence
  Description of Artificial Sequence: Synthetic coding sequence
atggccgccctgagacagccccaggtggccgagctgctggccgaggccagaagagccttcagagaggagttcggcgccgagcccgagctggccgtgagcgcccccggcagagtgaacctgatcggcgagcacaccgactacaaccagggcctggtgctgcccatggccctggagctgatgaccgtgctggtgggcagccccagaaaggacggcctggtgagcctgctgaccaccagcgagggcgccgacgagccccagagactgcagttccccctgcccaccgcccagagaagcctggagcccggcacccccagatgggccaactacgtgaagggcgtgatccagtactaccccgccgcccccctgcccggcttcagcgccgtggtggtgagcagcgtgcccctgggcggcggcctgagcagcagcgccagcctggaggtggccacctacaccttcctgcagcagctgtgccccgacagcggcaccatcgccgccagagcccaggtgtgccagcaggccgagcacagcttcgccggcatgccctgcggcatcatggaccagttcatcagcctgatgggccagaagggccacgccctgctgatcgactgcagaagcctggagaccagcctggtgcccctgagcgaccccaagctggccgtgctgatcaccaacagcaacgtgagacacagcctggccagcagcgagtaccccgtgagaagaagacagtgcgaggaggtggccagagccctgggcaaggagagcctgagagaggtgcagctggaggagctggaggccgccagagacctggtgagcaaggagggcttcagaagagccagacacgtggtgggcgagatcagaagaaccgcccaggccgccgccgccctgagaagaggcgactacagagccttcggcagactgatggtggagagccacagaagcctgagagacgactacgaggtgagctgccccgagctggaccagctggtggaggccgccctggccgtgcccggcgtgtacggcagcagaatgaccggcggcggcttcggcggctgcaccgtgaccctgctggaggccagcgccgccccccacgccatgagacacatccaggagcactacggcggcaccgccaccttctacctgagccaggccgccgacggcgccaaggtgctgtgcctgtag

SEQ ID NO: 1896 - DNA, 1569 bp, Artificial Sequence
  Description of Artificial Sequence: Synthetic coding sequence
atggccgccgtggtggccgccaccagatggtggcagctgctgctggtgctgagcgccgccggcatgggcgccagcggcgccccccagccccccaacatcctgctgctgctgatggacgacatgggctggggcgacctgggcgtgtacggcgagcccagcagagagacccccaacctggacagaatggccgccgagggcctgctgttccccaacttctacagcgccaaccccctgtgcagccccagcagagccgccctgctgaccggcagactgcccatcagaaacggcttctacaccaccaacgcccacgccagaaacgcctacaccccccaggagatcgtgggcggcatccccgacagcgagcagctgctgcccgagctgctgaagaaggccggctacgtgagcaagatcgtgggcaagtggcacctgggccacagaccccagttccaccccctgaagcacggcttcgacgagtggttcggcagccccaactgccacttcggcccctacgacaacaaggccagacccaacatccccgtgtacagagactgggagatggtgggcagatactacgaggagttccccatcaacctgaagaccggcgaggccaacctgacccagatctacctgcaggaggccctggacttcatcaagagacaggccagacaccaccccttcttcctgtactgggccgtggacgccacccacgcccccgtgtacgccagcaagcccttcctgggcaccagccagagaggcagatacggcgacgccgtgagagagatcgacgacagcatcggcaagatcctggagctgctgcaggacctgcacgtggccgacaacaccttcgtgttcttcaccagcgacaacggcgccgccctgatcagcgcccccgagcagggcggcagcaacggccccttcctgtgcggcaagcagaccaccttcgagggcggcatgagagagcccgccctggcctggtggcccggccacgtgaccgccggccaggtgagccaccagctgggcagcatcatggacctgttcaccaccagcctggccctggccggcctgaccccccccagcgacagagccatcgacggcctgaacctgctgcccaccctgctgcagggcagactgatggacagacccatcttctactacagaggcgacaccctgatggccgccaccctgggccagcacaaggcccacttctggacctggaccaacagctgggagaacttcagacagggcatcgacttctgccccggccagaacgtgagcggcgtgaccacccacaacctggaggaccacaccaagctgcccctgatcttccacctgggcagagaccccggcgagagattccccctgagcttcgccagcgccgagtaccaggaggccctgagcagaatcaccagcgtggtgcagcagcaccaggaggccctggtgcccgcccagccccagctgaacgtgtgcaactgggccgtgatgaactgggccccccccggctgcgagaagctgggcaagtgcctgaccccccccgagagcatccccaagaagtgcctgtggagccactag

SEQ ID NO: 1897 - DNA, 261 bp, Artificial Sequence
  Description of Artificial Sequence: Synthetic coding sequence
atggccgccgtggtggccgccaccagatggtggcagctgctgctggtgctgagcgccgccggcatgggcgccagcggcgccccccagccccccaacatcctgctgctgctgatggacgacagaggcagacactgcagccaggacggctaccccagcgccatggccagcaccccccccacccccatgcccgagacccccacccacagaagaagactgtgggccgccagccagaccagaagcagcagctgcagaagcttctag

SEQ ID NO: 1898 - DNA, 1344 bp, Artificial Sequence
  Description of Artificial Sequence: Synthetic coding sequence
atggccgccgtggtggccgccaccagatggtggcagctgctgctggtgctgagcgccgccggcatgggcgccagcggcgcccccggccagagagcctacaccccccaggagatcgtgggcggcatccccgacagcgagcagctgctgcccgagctgctgaagaaggccggctacgtgagcaagatcgtgggcaagtggcacctgggccacagaccccagttccaccccctgaagcacggcttcgacgagtggttcggcagccccaactgccacttcggcccctacgacaacaaggccagacccaacatccccgtgtacagagactgggagatggtgggcagatactacgaggagttccccatcaacctgaagaccggcgaggccaacctgacccagatctacctgcaggaggccctggacttcatcaagagacaggccagacaccaccccttcttcctgtactgggccgtggacgccacccacgcccccgtgtacgccagcaagcccttcctgggcaccagccagagaggcagatacggcgacgccgtgagagagatcgacgacagcatcggcaagatcctggagctgctgcaggacctgcacgtggccgacaacaccttcgtgttcttcaccagcgacaacggcgccgccctgatcagcgcccccgagcagggcggcagcaacggccccttcctgtgcggcaagcagaccaccttcgagggcggcatgagagagcccgccctggcctggtggcccggccacgtgaccgccggccaggtgagccaccagctgggcagcatcatggacctgttcaccaccagcctggccctggccggcctgaccccccccagcgacagagccatcgacggcctgaacctgctgcccaccctgctgcagggcagactgatggacagacccatcttctactacagaggcgacaccctgatggccgccaccctgggccagcacaaggcccacttctggacctggaccaacagctgggagaacttcagacagggcatcgacttctgccccggccagaacgtgagcggcgtgaccacccacaacctggaggaccacaccaagctgcccctgatcttccacctgggcagagaccccggcgagagattccccctgagcttcgccagcgccgagtaccaggaggccctgagcagaatcaccagcgtggtgcagcagcaccaggaggccctggtgcccgcccagccccagctgaacgtgtgcaactgggccgtgatgaactgggccccccccggctgcgagaagctgggcaagtgcctgaccccccccgagagcatccccaagaagtgcctgtggagccactag

SEQ ID NO: 1899 - DNA, 1140 bp, Artificial Sequence
  Description of Artificial Sequence: Synthetic coding sequence
atgagcagaagcggcaccgacccccagcagagacagcaggccagcgaggccgacgccgccgccgccaccttcagagccaacgaccaccagcacatcagatacaaccccctgcaggacgagtgggtgctggtgagcgcccacagaatgaagagaccctggcagggccaggtggagccccagctgctgaagaccgtgcccagacacgaccccctgaaccccctgtgccccggcgccatcagagccaacggcgaggtgaacccccagtacgacagcaccttcctgttcgacaacgacttccccgccctgcagcccgacgcccccagccccggccccagcgaccaccccctgttccaggccaagagcgccagaggcgtgtgcaaggtgatgtgcttccacccctggagcgacgtgaccctgcccctgatgagcgtgcccgagatcagagccgtggtggacgcctgggccagcgtgaccgaggagctgggcgcccagtacccctgggtgcagatcttcgagaacaagggcgccatgatgggctgcagcaacccccacccccactgccaggtgtgggccagcagcttcctgcccgacatcgcccagagagaggagagaagccagcaggcctacaagagccagcacggcgagcccctgctgatggagtacagcagacaggagctgctgagaaaggagagactggtgctgaccagcgagcactggctggtgctggtgcccttctgggccacctggccctaccagaccctgctgctgcccagaagacacgtgagaagactgcccgagctgacccccgccgagagagacgacctggccagcatcatgaagaagctgctgaccaagtacgacaacctgttcgagaccagcttcccctacagcatgggctggcacggcgcccccaccggcagcgaggccggcgccaactggaaccactggcagctgcacgcccactactacccccccctgctgagaagcgccaccgtgagaaagttcatggtgggctacgagatgctggcccaggcccagagagacctgacccccgagcaggccgccgagagactgagagccctgcccgaggtgcactaccacctgggccagaaggacagagagaccgccaccatcgcctag

SEQ ID NO: 1900 - DNA, 813 bp, Artificial Sequence
  Description of Artificial Sequence: Synthetic coding sequence
atgaccctgagcaccctgtgcgtgctgggccccagcgagcccaccgagagcaaggtgatgtgcttccacccctggagcgacgtgaccctgcccctgatgagcgtgcccgagatcagagccgtggtggacgcctgggccagcgtgaccgaggagctgggcgcccagtacccctgggtgcagatcttcgagaacaagggcgccatgatgggctgcagcaacccccacccccactgccaggtgtgggccagcagcttcctgcccgacatcgcccagagagaggagagaagccagcaggcctacaagagccagcacggcgagcccctgctgatggagtacagcagacaggagctgctgagaaaggagagactggtgctgaccagcgagcactggctggtgctggtgcccttctgggccacctggccctaccagaccctgctgctgcccagaagacacgtgagaagactgcccgagctgacccccgccgagagagacgacctggccagcatcatgaagaagctgctgaccaagtacgacaacctgttcgagaccagcttcccctacagcatgggctggcacggcgcccccaccggcagcgaggccggcgccaactggaaccactggcagctgcacgcccactactacccccccctgctgagaagcgccaccgtgagaaagttcatggtgggctacgagatgctggcccaggcccagagagacctgacccccgagcaggccgccgagagactgagagccctgcccgaggtgcactaccacctgggccagaaggacagagagaccgccaccatcgcctag

SEQ ID NO: 1901 - DNA, 255 bp, Artificial Sequence
  Description of Artificial Sequence: Synthetic coding sequence
atgagcagaagcggcaccgacccccagcagagacagcaggccagcgaggccgacgccgccgccgccaccttcagagccaacgaccaccagcacatcagatacaaccccctgcaggacgagtgggtgctggtgagcgcccacagaatgaagagaccctggcagggccaggtggagccccagctgctgaagaccgtgcccagacacgaccccctgaaccccctgtgccccggcgccatcagagccaacggcgagtag

SEQ ID NO: 1902 - DNA, 2229 bp, Artificial Sequence
  Description of Artificial Sequence: Synthetic coding sequence
atgagcccccagaagagagtgaagaacgtgcaggcccagaacagaaccagccagggcagcagcagcttccagaccaccctgagcgcctggaaggtgaagcaggaccccagcaacagcaagaacatcagcaagcacggccagaacaaccccgtgggcgactacgagcacgccgacgaccaggccgaggaggacgccctgcagatggccgtgggctacttcgagaagggccccatcaaggccagccagaacaaggacaagaccctggagaagcacctgaagaccgtggagaacgtggcctggaagaacggcctggccagcgaggagatcgacatcctgctgaacatcgccctgagcggcaagttcggcaacgccgtgaacaccagaatcctgaagtgcatgatccccgccaccgtgatcagcgaggacagcgtggtgaaggccgtgagctggctgtgcgtgggcaagtgcagcggcagcaccaaggtgctgttctacagatggctggtggccatgttcgacttcatcgacagaaaggagcagatcaacctgctgtacggcttcttcttcgccagcctgcaggacgacgccctgtgcccctacgtgtgccacctgctgtacctgctgaccaagaaggagaacgtgaagcccttcagagtgagaaagctgctggacctgcaggccaagatgggcatgcagccccacctgcaggccctgctgagcctgtacaagttcttcgcccccgccctgatcagcgtgagcctgcccgtgagaaagaagatctacttcaagaacagcgagaacctgtggaagaccgccctgctggccgtgaagcagagaaacagaggccccagccccgagcccctgaagctgatgctgggccccgccaacgtgagacccctgaagagaaagtggaacagcctgagcgtgatccccgtgctgaacagcagcagctacaccaaggagtgcggcaagaaggagatgagcctgagcgactgcctgaacagaagcggcagcttccccctggagcagctgcagagcttcccccagctgctgcagaacatccactgcctggagctgcccagccagatgggcagcgtgctgaacaacagcctgctgctgcactacatcaactgcgtgagagacgagcccgtgctgctgagattctactactggctgagccagaccctgcaggaggagtgcatctggtacaaggtgaacaactacgagcacggcaaggagttcaccaacttcctggacaccatcatcagagccgagtgcttcctgcaggagggcttctacagctgcgaggccttcctgtacaagagcctgcccctgtgggacggcctgtgctgcagaagccagttcctgcagctggtgagctggatccccttcagcagcttcagcgaggtgaagcccctgctgttcgaccacctggcccagctgttcttcaccagcaccatctacttcaagtgcagcgtgctgcagagcctgaaggagctgctgcagaactggctgctgtggctgagcatggacatccacatgaagcccgtgaccaacagccccctggagaccaccctgggcggcagcatgaacagcgtgagcaagctgatccactacgtgggctggctgagcaccaccgccatgagactggagagcaacaacaccttcctgctgcacttcatcctggacttctacgagaaggtgtgcgacatctacatcaactacaacctgcccctggtggtgctgttcccccccggcatcttctacagcgccctgctgagcctggacaccagcatcctgaaccagctgtgcttcatcatgcacagatacagaaagaacctgaccgccgccaagaagaacgagctggtgcagaagaccaagagcgagttcaacttcagcagcaagacctaccaggagttcaaccactacctgaccagcatggtgggctgcctgtggaccagcaagcccttcggcaagggcatctacatcgaccccgagatcctggagaagaccggcgtggccgagtacaagaacagcctgaacgtggtgcaccaccccagcttcctgagctacgccgtgagcttcctgctgcagggcaagaagtggagctggtacctggactacctgttcagccagggcctgcagggcctgaagctgttcatcagaagcagcgtgcaccacagcagcatccccagagccgagggcatcaactgcaacaaccagtactag

SEQ ID NO: 1903 - DNA, 636 bp, Artificial Sequence
  Description of Artificial Sequence: Synthetic coding sequence
atgaagctgtgggacgtggtggccgtgtgcctggtgctgctgcacaccgccagcgccttccccctgcccgccggcaagagaccccccgaggcccccgccgaggacagaagcctgggcagaagaagagcccccttcgccctgagcagcgacagcaacatgcccgaggactaccccgaccagttcgacgacgtgatggacttcatccaggccaccatcaagagactgaagagaagccccgacaagcagatggccgtgctgcccagaagagagagaaacagacaggccgccgccgccaaccccgagaacagcagaggcaagggcagaagaggccagagaggcaagaacagaggctgcgtgctgaccgccatccacctgaacgtgaccgacctgggcctgggctacgagaccaaggaggagctgatcttcagatactgcagcggcagctgcgacgccgccgagaccacctacgacaagatcctgaagaacctgagcagaaacagaagactggtgagcgacaaggtgggccaggcctgctgcagacccatcgccttcgacgacgacctgagcttcctggacgacaacctggtgtaccacatcctgagaaagcacagcgccaagagatgcggctgcatctag

SEQ ID NO: 1904 - DNA, 558 bp, Artificial Sequence
  Description of Artificial Sequence: Synthetic coding sequence
atgaagctgtgggacgtggtggccgtgtgcctggtgctgctgcacaccgccagcgccttccccctgcccgccgccaacatgcccgaggactaccccgaccagttcgacgacgtgatggacttcatccaggccaccatcaagagactgaagagaagccccgacaagcagatggccgtgctgcccagaagagagagaaacagacaggccgccgccgccaaccccgagaacagcagaggcaagggcagaagaggccagagaggcaagaacagaggctgcgtgctgaccgccatccacctgaacgtgaccgacctgggcctgggctacgagaccaaggaggagctgatcttcagatactgcagcggcagctgcgacgccgccgagaccacctacgacaagatcctgaagaacctgagcagaaacagaagactggtgagcgacaaggtgggccaggcctgctgcagacccatcgccttcgacgacgacctgagcttcctggacgacaacctggtgtaccacatcctgagaaagcacagcgccaagagatgcggctgcatctag

SEQ ID NO: 1905 - DNA, 687 bp, Artificial Sequence
  Description of Artificial Sequence: Synthetic coding sequence
atgcagagcctgcccaacagcaacggcgccgccgccggcagagacttcaagatgaagctgtgggacgtggtggccgtgtgcctggtgctgctgcacaccgccagcgccttccccctgcccgccggcaagagaccccccgaggcccccgccgaggacagaagcctgggcagaagaagagcccccttcgccctgagcagcgacagcaacatgcccgaggactaccccgaccagttcgacgacgtgatggacttcatccaggccaccatcaagagactgaagagaagccccgacaagcagatggccgtgctgcccagaagagagagaaacagacaggccgccgccgccaaccccgagaacagcagaggcaagggcagaagaggccagagaggcaagaacagaggctgcgtgctgaccgccatccacctgaacgtgaccgacctgggcctgggctacgagaccaaggaggagctgatcttcagatactgcagcggcagctgcgacgccgccgagaccacctacgacaagatcctgaagaacctgagcagaaacagaagactggtgagcgacaaggtgggccaggcctgctgcagacccatcgccttcgacgacgacctgagcttcctggacgacaacctggtgtaccacatcctgagaaagcacagcgccaagagatgcggctgcatctag

SEQ ID NO: 1906 - DNA, 186 bp, Artificial Sequence
  Description of Artificial Sequence: Synthetic coding sequence
atgaagctgtgggacgtggtggccgtgtgcctggtgctgctgcacaccgccagcgccttccccctgcccgccgccaacatgcccgaggactaccccgaccagttcgacgacgtgatggacttcatccaggccaccatcaagagactgaagagaagccccgacaagcagatggccgtgctgccctag

SEQ ID NO: 1907 - DNA, 186 bp, Artificial Sequence; identical to SEQ ID NO: 1906
  Description of Artificial Sequence: Synthetic coding sequence

SEQ ID NO: 1908 - DNA, 558 bp, Artificial Sequence; identical to SEQ ID NO: 1904
  Description of Artificial Sequence: Synthetic coding sequence

SEQ ID NO: 1909 - DNA, 609 bp, Artificial Sequence
  Description of Artificial Sequence: Synthetic coding sequence
atgcagagcctgcccaacagcaacggcgccgccgccggcagagacttcaagatgaagctgtgggacgtggtggccgtgtgcctggtgctgctgcacaccgccagcgccttccccctgcccgccgccaacatgcccgaggactaccccgaccagttcgacgacgtgatggacttcatccaggccaccatcaagagactgaagagaagccccgacaagcagatggccgtgctgcccagaagagagagaaacagacaggccgccgccgccaaccccgagaacagcagaggcaagggcagaagaggccagagaggcaagaacagaggctgcgtgctgaccgccatccacctgaacgtgaccgacctgggcctgggctacgagaccaaggaggagctgatcttcagatactgcagcggcagctgcgacgccgccgagaccacctacgacaagatcctgaagaacctgagcagaaacagaagactggtgagcgacaaggtgggccaggcctgctgcagacccatcgccttcgacgacgacctgagcttcctggacgacaacctggtgtaccacatcctgagaaagcacagcgccaagagatgcggctgcatctag

SEQ ID NO: 1910 - DNA, 543 bp, Artificial Sequence
  Description of Artificial Sequence: Synthetic coding sequence
atgaagagcatctacttcgtggccggcctgttcgtgatgctggtgcagggcagctggcagagaagcctgcaggacaccgaggagaagagcagaagcttcagcgccagccaggccgaccccctgagcgaccccgaccagatgaacgaggacaagagacacagccagggcaccttcaccagcgactacagcaagtacctggacagcagaagagcccaggacttcgtgcagtggctgatgaacaccaagagaaacagaaacaacatcgccaagagacacgacgagttcgagagacacgccgagggcaccttcaccagcgacgtgagcagctacctggagggccaggccgccaaggagttcatcgcctggctggtgaagggcagaggcagaagagacttccccgaggaggtggccatcgtggaggagctgggcagaagacacgccgacggcagcttcagcgacgagatgaacaccatcctggacaacctggccgccagagacttcatcaactggctgatccagaccaagatcaccgacagaaagtag

SEQ ID NO: 1911 - DNA, 543 bp, Artificial Sequence; identical to SEQ ID NO: 1910
  Description of Artificial Sequence: Synthetic coding sequence

SEQ ID NO: 1912 - DNA, 2262 bp, Artificial Sequence
  Description of Artificial Sequence: Synthetic coding sequence
agagcccccgacagaagaggcagccccagactggccagcaccagactgggcgccctgagactgagacccagcagaagagtgcccgccagagcccccgcccccgcccaggcccccctgcccctgggccccagactgctgggcctgagaagaaacatggccgcccccatgacccccgccgccagacccgaggactacgaggccgccctgaacgccgccctggccgacgtgcccgagctggccagactgctggagatcgacccctacctgaagccctacgccgtggacttccagagaagatacaagcagttcagccagatcctgaagaacatcggcgagaacgagggcggcatcgacaagttcagcagaggctacgagagcttcggcgtgcacagatgcgccgacggcggcctgtactgcaaggagtgggcccccggcgccgagggcgtgttcctgaccggcgacttcaacggctggaaccccttcagctacccctacaagaagctggactacggcaagtgggagctgtacatcccccccaagcagaacaagagcgtgctggtgccccacggcagcaagctgaaggtggtgatcaccagcaagagcggcgagatcctgtacagaatcagcccctgggccaagtacgtggtgagagagggcgacaacgtgaactacgactggatccactgggaccccgagcacagctacgagttcaagcacagcagacccaagaagcccagaagcctgagaatctacgagagccacgtgggcatcagcagccacgagggcaaggtggccagctacaagcacttcacctgcaacgtgctgcccagaatcaagggcctgggctacaactgcatccagctgatggccatcatggagcacgcctactacgccagcttcggctaccagatcaccagcttcttcgccgccagcagcagatacggcacccccgaggagctgcaggagctggtggacaccgcccacagcatgggcatcatcgtgctgctggacgtggtgcacagccacgccagcaagaacagcgccgacggcctgaacatgttcgacggcaccgacagctgctacttccacagcggccccagaggcacccacgacctgtgggacagcagactgttcgcctacagcagctgggagatcctgagattcctgctgagcaacatcagatggtggctggaggagtacagattcgacggcttcagattcgacggcgtgaccagcatgctgtaccaccaccacggcgtgggccagggcttcagcggcgactacagcgagtacttcggcctgcaggtggacgaggacgccctgacctacctgatgctggccaaccacctggtgcacaccctgtgccccgacagcatcaccatcgccgaggacgtgagcggcatgcccgccctgtgcagccccatcagccagggcggcggcggcttcgactacagactggccatggccatccccgacaagtggatccagctgctgaaggagttcaaggacgaggactggaacatgggcgacatcgtgtacaccctgaccaacagaagatacctggagaagtgcatcgcctacgccgagagccacgaccaggccctggtgggcgacaagagcctggccttctggctgatggacgccgagatgtacaccaacatgagcgtgctgacccccttcacccccgtgatcgacagaggcatccagctgcacaagatgatcagactgatcacccacggcctgggcggcgagggctacctgaacttcatgggcaacgagttcggccaccccgagtggctggacttccccagaaagggcaacaacgagagctaccactacgccagaagacagttccacctgaccgacgacgacctgctgagatacaagttcctgaacaacttcgacagagacatgaacagactggaggagagatacggctggctggccgccccccaggcctacgtgagcgagaagcacgagggcaacaagatcatcgccttcgagagagccggcctgctgttcatcttcaacttccaccccagcaagagctacaccgactacagagtgggcaccgccctgcccggcaagttcaagatcgtgctggacagcgacgccgccgagtacggcggccaccagagactggaccacagcaccgacttcttcagcgaggccttcgagcacaacggcagaccctacagcctgctggtgtacatccccagcagagtggccctgatcctgcagaacgtggacctgcccaactag

SEQ ID NO: 1913 - DNA, 2109 bp, Artificial Sequence
  Description of Artificial Sequence: Synthetic coding sequence
atggccgcccccatgacccccgccgccagacccgaggactacgaggccgccctgaacgccgccctggccgacgtgcccgagctggccagactgctggagatcgacccctacctgaagccctacgccgtggacttccagagaagatacaagcagttcagccagatcctgaagaacatcggcgagaacgagggcggcatcgacaagttcagcagaggctacgagagcttcggcgtgcacagatgcgccgacggcggcctgtactgcaaggagtgggcccccggcgccgagggcgtgttcctgaccggcgacttcaacggctggaaccccttcagctacccctacaagaagctggactacggcaagtgggagctgtacatcccccccaagcagaacaagagcgtgctggtgccccacggcagcaagctgaaggtggtgatcaccagcaagagcggcgagatcctgtacagaatcagcccctgggccaagtacgtggtgagagagggcgacaacgtgaactacgactggatccactgggaccccgagcacagctacgagttcaagcacagcagacccaagaagcccagaagcctgagaatctacgagagccacgtgggcatcagcagccacgagggcaaggtggccagctacaagcacttcacctgcaacgtgctgcccagaatcaagggcctgggctacaactgcatccagctgatggccatcatggagcacgcctactacgccagcttcggctaccagatcaccagcttcttcgccgccagcagcagatacggcacccccgaggagctgcaggagctggtggacaccgcccacagcatgggcatcatcgtgctgctggacgtggtgcacagccacgccagcaagaacagcgccgacggcctgaacatgttcgacggcaccgacagctgctacttccacagcggccccagaggcacccacgacctgtgggacagcagactgttcgcctacagcagctgggagatcctgagattcctgctgagcaacatcagatggtggctggaggagtacagattcgacggcttcagattcgacggcgtgaccagcatgctgtaccaccaccacggcgtgggccagggcttcagcggcgactacagcgagtacttcggcctgcaggtggacgaggacgccctgacctacctgatgctggccaaccacctggtgcacaccctgtgccccgacagcatcaccatcgccgaggacgtgagcggcatgcccgccctgtgcagccccatcagccagggcggcggcggcttcgactacagactggccatggccatccccgacaagtggatccagctgctgaaggagttcaaggacgaggactggaacatgggcgacatcgtgtacaccctgaccaacagaagatacctggagaagtgcatcgcctacgccgagagccacgaccaggccctggtgggcgacaagagcctggccttctggctgatggacgccgagatgtacaccaacatgagcgtgctgacccccttcacccccgtgatcgacagaggcatccagctgcacaagatgatcagactgatcacccacggcctgggcggcgagggctacctgaacttcatgggcaacgagttcggccaccccgagtggctggacttccccagaaagggcaacaacgagagctaccactacgccagaagacagttccacctgaccgacgacgacctgctgagatacaagttcctgaacaacttcgacagagacatgaacagactggaggagagatacggctggctggccgccccccaggcctacgtgagcgagaagcacgagggcaacaagatcatcgccttcgagagagccggcctgctgttcatcttcaacttccaccccagcaagagctacaccgactacagagtgggcaccgccctgcccggcaagttcaagatcgtgctggacagcgacgccgccgagtacggcggccaccagagactggaccacagcaccgacttcttcagcgaggccttcgagcacaacggcagaccctacagcctgctggtgtacatccccagcagagtggccctgatcctgcagaacgtggacctgcccaactag

SEQ ID NO: 1914 - DNA, 1398 bp, Artificial Sequence
  Description of Artificial Sequence: Synthetic coding sequence
atggccatcatggagcacgcctactacgccagcttcggctaccagatcaccagcttcttcgccgccagcagcagatacggcacccccgaggagctgcaggagctggtggacaccgcccacagcatgggcatcatcgtgctgctggacgtggtgcacagccacgccagcaagaacagcgccgacggcctgaacatgttcgacggcaccgacagctgctacttccacagcggccccagaggcacccacgacctgtgggacagcagactgttcgcctacagcagctgggagatcctgagattcctgctgagcaacatcagatggtggctggaggagtacagattcgacggcttcagattcgacggcgtgaccagcatgctgtaccaccaccacggcgtgggccagggcttcagcggcgactacagcgagtacttcggcctgcaggtggacgaggacgccctgacctacctgatgctggccaaccacctggtgcacaccctgtgccccgacagcatcaccatcgccgaggacgtgagcggcatgcccgccctgtgcagccccatcagccagggcggcggcggcttcgactacagactggccatggccatccccgacaagtggatccagctgctgaaggagttcaaggacgaggactggaacatgggcgacatcgtgtacaccctgaccaacagaagatacctggagaagtgcatcgcctacgccgagagccacgaccaggccctggtgggcgacaagagcctggccttctggctgatggacgccgagatgtacaccaacatgagcgtgctgacccccttcacccccgtgatcgacagaggcatccagctgcacaagatgatcagactgatcacccacggcctgggcggcgagggctacctgaacttcatgggcaacgagttcggccaccccgagtggctggacttccccagaaagggcaacaacgagagctaccactacgccagaagacagttccacctgaccgacgacgacctgctgagatacaagttcctgaacaacttcgacagagacatgaacagactggaggagagatacggctggctggccgccccccaggcctacgtgagcgagaagcacgagggcaacaagatcatcgccttcgagagagccggcctgctgttcatcttcaacttccaccccagcaagagctacaccgactacagagtgggcaccgccctgcccggcaagttcaagatcgtgctggacagcgacgccgccgagtacggcggccaccagagactggaccacagcaccgacttcttcagcgaggccttcgagcacaacggcagaccctacagcctgctggtgtacatccccagcagagtggccctgatcctgcagaacgtggacctgcccaactag

SEQ ID NO: 1915 - DNA, 1074 bp, Artificial Sequence
  Description of Artificial Sequence: Synthetic coding sequence
atggaggagggcatgaacgtgctgcacgacttcggcatccagagcacccactacctgcaggtgaactaccaggacagccaggactggttcatcctggtgagcgtgatcgccgacctgagaaacgccttctacgtgctgttccccatctggttccacctgcaggaggccgtgggcatcaagctgctgtgggtggccgtgatcggcgactggctgaacctggtgttcaagtggatcctgttcggccagagaccctactggtgggtgctggacaccgactactacagcaacaccagcgtgcccctgatcaagcagttccccgtgacctgcgagaccggccccggcagccccagcggccacgccatgggcaccgccggcgtgtactacgtgatggtgaccagcaccctgagcatcttccagggcaagatcaagcccacctacagattcagatgcctgaacgtgatcctgtggctgggcttctgggccgtgcagctgaacgtgtgcctgagcagaatctacctggccgcccacttcccccaccaggtggtggccggcgtgctgagcggcatcgccgtggccgagaccttcagccacatccacagcatctacaacgccagcctgaagaagtacttcctgatcaccttcttcctgttcagcttcgccatcggcttctacctgctgctgaagggcctgggcgtggacctgctgtggaccctggagaaggcccagagatggtgcgagcagcccgagtgggtgcacatcgacaccacccccttcgccagcctgctgaagaacctgggcaccctgttcggcctgggcctggccctgaacagcagcatgtacagagagagctgcaagggcaagctgagcaagtggctgcccttcagactgagcagcatcgtggccagcctggtgctgctgcacgtgttcgacagcctgaagccccccagccaggtggagctggtgttctacgtgctgagcttctgcaagagcgccgtggtgcccctggccagcgtgagcgtgatcccctactgcctggcccaggtgctgggccagccccacaagaagagcctgtag

SEQ ID NO: 1916 - DNA, 2859 bp, Artificial Sequence
  Description of Artificial Sequence: Synthetic coding sequence
atgggcgtgagacaccccccctgcagccacagactgctggccgtgtgcgccctggtgagcctggccaccgccgccctgctgggccacatcctgctgcacgacttcctgctggtgcccagagagctgagcggcagcagccccgtgctggaggagacccaccccgcccaccagcagggcgccagcagacccggccccagagacgcccaggcccaccccggcagacccagagccgtgcccacccagtgcgacgtgccccccaacagcagattcgactgcgcccccgacaaggccatcacccaggagcagtgcgaggccagaggctgctgctacatccccgccaagcagggcctgcagggcgcccagatgggccagccctggtgcttcttcccccccagctaccccagctacaagctggagaacctgagcagcagcgagatgggctacaccgccaccctgaccagaaccacccccaccttcttccccaaggacatcctgaccctgagactggacgtgatgatggagaccgagaacagactgcacttcaccatcaaggaccccgccaacagaagatacgaggtgcccctggagaccccccacgtgcacagcagagcccccagccccctgtacagcgtggagttcagcgaggagcccttcggcgtgatcgtgagaagacagctggacggcagagtgctgctgaacaccaccgtggcccccctgttcttcgccgaccagttcctgcagctgagcaccagcctgcccagccagtacatcaccggcctggccgagcacctgagccccctgatgctgagcaccagctggaccagaatcaccctgtggaacagagacctggcccccacccccggcgccaacctgtacggcagccaccccttctacctggccctggaggacggcggcagcgcccacggcgtgttcctgctgaacagcaacgccatggacgtggtgctgcagcccagccccgccctgagctggagaagcaccggcggcatcctggacgtgtacatcttcctgggccccgagcccaagagcgtggtgcagcagtacctggacgtggtgggctaccccttcatgcccccctactggggcctgggcttccacctgtgcagatggggctacagcagcaccgccatcaccagacaggtggtggagaacatgaccagagcccacttccccctggacgtgcagtggaacgacctggactacatggacagcagaagagacttcaccttcaacaaggacggcttcagagacttccccgccatggtgcaggagctgcaccagggcggcagaagatacatgatgatcgtggaccccgccatcagcagcagcggccccgccggcagctacagaccctacgacgagggcctgagaagaggcgtgttcatcaccaacgagaccggccagcccctgatcggcaaggtgtggcccggcagcaccgccttccccgacttcaccaaccccaccgccctggcctggtgggaggacatggtggccgagttccacgaccaggtgcccttcgacggcatgtggatcgacatgaacgagcccagcaacttcatcagaggcagcgaggacggctgccccaacaacgagctggagaaccccccctacgtgcccggcgtggtgggcggcaccctgcaggccgccaccatctgcgccagcagccaccagttcctgagcacccactacaacctgcacaacctgtacggcctgaccgaggccatcgccagccacagagccctggtgaaggccagaggcaccagacccttcgtgatcagcagaagcaccttcgccggccacggcagatacgccggccactggaccggcgacgtgtggagcagctgggagcagctggccagcagcgtgcccgagatcctgcagttcaacctgctgggcgtgcccctggtgggcgccgacgtgtgcggcttcctgggcaacaccagcgaggagctgtgcgtgagatggacccagctgggcgccttctaccccttcatgagaaaccacaacagcctgctgagcctgccccaggagccctacagcttcagcgagcccgcccagcaggccatgagaaaggccctgaccctgagatacgccctgctgccccacctgtacaccctgttccaccaggcccacgtggccggcgagaccgtggccagacccctgttcctggagttccccaaggacagcagcacctggaccgtggaccaccagctgctgtggggcgaggccctgctgatcacccccgtgctgcaggccggcaaggccgaggtgaccggctacttccccctgggcacctggtacgacctgcagaccgtgcccgtggaggccctgggcagcctgccccccccccccgccgcccccagagagcccgccatccacagcgagggccagtgggtgaccctgcccgcccccctggacaccatcaacgtgcacctgagagccggctacatcatccccctgcagggccccggcctgaccaccaccgagagcagacagcagcccatggccctggccgtggccctgaccaagggcggcgaggccagaggcgagctgttctgggacgacggcgagagcctggaggtgctggagagaggcgcctacacccaggtgatcttcctggccagaaacaacaccatcgtgaacgagctggtgagagtgaccagcgagggcgccggcctgcagctgcagaaggtgaccgtgctgggcgtggccaccgccccccagcaggtgctgagcaacggcgtgcccgtgagcaacttcacctacagccccgacaccaaggtgctggacatctgcgtgagcctgctgatgggcgagcagttcctggtgagctggtgctag

SEQ ID NO: 1917 - DNA, 2859 bp, Artificial Sequence; identical to SEQ ID NO: 1916
  Description of Artificial Sequence: Synthetic coding sequence

SEQ ID NO: 1918 - DNA, 1611 bp, Artificial Sequence
  Description of Artificial Sequence: Synthetic coding sequence
atggagttcagcagccccagcagagaggagtgccccaagcccctgagcagagtgagcatcatggccggcagcctgaccggcctgctgctgctgcaggccgtgagctgggccagcggcgccagaccctgcatccccaagagcttcggctacagcagcgtggtgtgcgtgtgcaacgccacctactgcgacagcttcgacccccccaccttccccgccctgggcaccttcagcagatacgagagcaccagaagcggcagaagaatggagctgagcatgggccccatccaggccaaccacaccggcaccggcctgctgctgaccctgcagcccgagcagaagttccagaaggtgaagggcttcggcggcgccatgaccgacgccgccgccctgaacatcctggccctgagcccccccgcccagaacctgctgctgaagagctacttcagcgaggagggcatcggctacaacatcatcagagtgcccatggccagctgcgacttcagcatcagaacctacacctacgccgacacccccgacgacttccagctgcacaacttcagcctgcccgaggaggacaccaagctgaagatccccctgatccacagagccctgcagctggcccagagacccgtgagcctgctggccagcccctggaccagccccacctggctgaagaccaacggcgccgtgaacggcaagggcagcctgaagggccagcccggcgacatctaccaccagacctgggccagatacttcgtgaagttcctggacgcctacgccgagcacaagctgcagttctgggccgtgaccgccgagaacgagcccagcgccggcctgctgagcggctaccccttccagtgcctgggcttcacccccgagcaccagagagacttcatcgccagagacctgggccccaccctggccaacagcacccaccacaacgtgagactgctgatgctggacgaccagagactgctgctgccccactgggccaaggtggtgctgaccgaccccgaggccgccaagtacgtgcacggcatcgccgtgcactggtacctggacttcctggcccccgccaaggccaccctgggcgagacccacagactgttccccaacaccatgctgttcgccagcgaggcctgcgtgggcagcaagttctgggagcagagcgtgagactgggcagctgggacagaggcatgcagtacagccacagcatcatcaccaacctgctgtaccacgtggtgggctggaccgactggaacctggccctgaaccccgagggcggccccaactgggtgagaaacttcgtggacagccccatcatcgtggacatcaccaaggacaccttctacaagcagcccatgttctaccacctgggccacttcagcaagttcatccccgagggcagccagagagtgggcctggtggccagccagaagaacgacctggacgccgtggccctgatgcaccccgacggcagcgccgtggtggtggtgctgaacagaagcagcaaggacgtgcccctgaccatcaaggaccccgccgtgggcttcctggagaccatcagccccggctacagcatccacacctacctgtggagaagacagtag

SEQ ID NO: 1919 - DNA, 1611 bp, Artificial Sequence; identical to SEQ ID NO: 1918
  Description of Artificial Sequence: Synthetic coding sequence

SEQ ID NO: 1920 - DNA, 1566 bp, Artificial Sequence
  Description of Artificial Sequence: Synthetic coding sequence
atggagttcagcagccccagcagagaggagtgccccaagcccctgagcagagtgagcatcatggccggcagcctgaccggcctgctgctgctgcaggccgtgagctgggccagcggcgccagaccctgcatccccaagagcttcggctacagcagcgtggtgtgcgtgtgcaacgccacctactgcgacagcttcgacccccccaccttccccgccctgggcaccttcagcagatacgagagcaccagaagcggcagaagaatggagctgagcatgggccccatccaggccaaccacaccggcaccggcctgctgctgaccctgcagcccgacgccgccgccctgaacatcctggccctgagcccccccgcccagaacctgctgctgaagagctacttcagcgaggagggcatcggctacaacatcatcagagtgcccatggccagctgcgacttcagcatcagaacctacacctacgccgacacccccgacgacttccagctgcacaacttcagcctgcccgaggaggacaccaagctgaagatccccctgatccacagagccctgcagctggcccagagacccgtgagcctgctggccagcccctggaccagccccacctggctgaagaccaacggcgccgtgaacggcaagggcagcctgaagggccagcccggcgacatctaccaccagacctgggccagatacttcgtgaagttcctggacgcctacgccgagcacaagctgcagttctgggccgtgaccgccgagaacgagcccagcgccggcctgctgagcggctaccccttccagtgcctgggcttcacccccgagcaccagagagacttcatcgccagagacctgggccccaccctggccaacagcacccaccacaacgtgagactgctgatgctggacgaccagagactgctgctgccccactgggccaaggtggtgctgaccgaccccgaggccgccaagtacgtgcacggcatcgccgtgcactggtacctggacttcctggcccccgccaaggccaccctgggcgagacccacagactgttccccaacaccatgctgttcgccagcgaggcctgcgtgggcagcaagttctgggagcagagcgtgagactgggcagctgggacagaggcatgcagtacagccacagcatcatcaccaacctgctgtaccacgtggtgggctggaccgactggaacctggccctgaaccccgagggcggccccaactgggtgagaaacttcgtggacagccccatcatcgtggacatcaccaaggacaccttctacaagcagcccatgttctaccacctgggccacttcagcaagttcatccccgagggcagccagagagtgggcctggtggccagccagaagaacgacctggacgccgtggccctgatgcaccccgacggcagcgccgtggtggtggtgctgaacagaagcagcaaggacgtgcccctgaccatcaaggaccccgccgtgggcttcctggagaccatcagccccggctacagcatccacacctacctgtggagaagacagtag

SEQ ID NO: 1921 - DNA, 1464 bp, Artificial Sequence
  Description of Artificial Sequence: Synthetic coding sequence
atggagttcagcagccccagcagagaggagtgccccaagcccctgagcagagtgagcatcatggccggcagcctgaccggcctgctgctgctgcaggccgtgagctgggccagcggcgccagaccctgcatccccaagagcttcggctacagcagcgtggtgtgcgtgtgcaacgccacctactgcgacagcttcgacccccccaccttccccgccctgggcaccttcagcagatacgagagcaccagaagcggcagaagaatggagctgagcatgggccccatccaggccaaccacaccggcaccggcatcggctacaacatcatcagagtgcccatggccagctgcgacttcagcatcagaacctacacctacgccgacacccccgacgacttccagctgcacaacttcagcctgcccgaggaggacaccaagctgaagatccccctgatccacagagccctgcagctggcccagagacccgtgagcctgctggccagcccctggaccagccccacctggctgaagaccaacggcgccgtgaacggcaagggcagcctgaagggccagcccggcgacatctaccaccagacctgggccagatacttcgtgaagttcctggacgcctacgccgagcacaagctgcagttctgggccgtgaccgccgagaacgagcccagcgccggcctgctgagcggctaccccttccagtgcctgggcttcacccccgagcaccagagagacttcatcgccagagacctgggccccaccctggccaacagcacccaccacaacgtgagactgctgatgctggacgaccagagactgctgctgccccactgggccaaggtggtgctgaccgaccccgaggccgccaagtacgtgcacggcatcgccgtgcactggtacctggacttcctggcccccgccaaggccaccctgggcgagacccacagactgttccccaacaccatgctgttcgccagcgaggcctgcgtgggcagcaagttctgggagcagagcgtgagactgggcagctgggacagaggcatgcagtacagccacagcatcatcaccaacctgctgtaccacgtggtgggctggaccgactggaacctggccctgaaccccgagggcggccccaactgggtgagaaacttcgtggacagccccatcatcgtggacatcaccaaggacaccttctacaagcagcccatgttctaccacctgggccacttcagcaagttcatccccgagggcagccagagagtgggcctggtggccagccagaagaacgacctggacgccgtggccctgatgcaccccgacggcagcgccgtggtggtggtgctgaacagaagcagcaaggacgtgcccctgaccatcaaggaccccgccgtgggcttcctggagaccatcagccccggctacagcatccacacctacctgtggagaagacagtag

SEQ ID NO: 1922 - DNA, 1350 bp, Artificial Sequence
  Description of Artificial Sequence: Synthetic coding sequence
atggagctgagcatgggccccatccaggccaaccacaccggcaccggcctgctgctgaccctgcagcccgagcagaagttccagaaggtgaagggcttcggcggcgccatgaccgacgccgccgccctgaacatcctggccctgagcccccccgcccagaacctgctgctgaagagctacttcagcgaggagggcatcggctacaacatcatcagagtgcccatggccagctgcgacttcagcatcagaacctacacctacgccgacacccccgacgacttccagctgcacaacttcagcctgcccgaggaggacaccaagctgaagatccccctgatccacagagccctgcagctggcccagagacccgtgagcctgctggccagcccctggaccagccccacctggctgaagaccaacggcgccgtgaacggcaagggcagcctgaagggccagcccggcgacatctaccaccagacctgggccagatacttcgtgaagttcctggacgcctacgccgagcacaagctgcagttctgggccgtgaccgccgagaacgagcccagcgccggcctgctgagcggctaccccttccagtgcctgggcttcacccccgagcaccagagagacttcatcgccagagacctgggccccaccctggccaacagcacccaccacaacgtgagactgctgatgctggacgaccagagactgctgctgccccactgggccaaggtggtgctgaccgaccccgaggccgccaagtacgtgcacggcatcgccgtgcactggtacctggacttcctggcccccgccaaggccaccctgggcgagacccacagactgttccccaacaccatgctgttcgccagcgaggcctgcgtgggcagcaagttctgggagcagagcgtgagactgggcagctgggacagaggcatgcagtacagccacagcatcatcaccaacctgctgtaccacgtggtgggctggaccgactggaacctggccctgaaccccgagggcggccccaactgggtgagaaacttcgtggacagccccatcatcgtggacatcaccaaggacaccttctacaagcagcccatgttctaccacctgggccacttcagcaagttcatccccgagggcagccagagagtgggcctggtggccagccagaagaacgacctggacgccgtggccctgatgcaccccgacggcagcgccgtggtggtggtgctgaacagaagcagcaaggacgtgcccctgaccatcaaggaccccgccgtgggcttcctggagaccatcagccccggctacagcatccacacctacctgtggagaagacagtag

SEQ ID NO: 1923 - DNA, 1482 bp, Artificial Sequence
  Description of Artificial Sequence: Synthetic coding sequence
atgaccctgagaggctggagcttccaggtgctgcccgagagcaacgccacctactgcgacagcttcgacccccccaccttccccgccctgggcaccttcagcagatacgagagcaccagaagcggcagaagaatggagctgagcatgggccccatccaggccaaccacaccggcaccggcctgctgctgaccctgcagcccgagcagaagttccagaaggtgaagggcttcggcggcgccatgaccgacgccgccgccctgaacatcctggccctgagcccccccgcccagaacctgctgctgaagagctacttcagcgaggagggcatcggctacaacatcatcagagtgcccatggccagctgcgacttcagcatcagaacctacacctacgccgacacccccgacgacttccagctgcacaacttcagcctgcccgaggaggacaccaagctgaagatccccctgatccacagagccctgcagctggcccagagacccgtgagcctgctggccagcccctggaccagccccacctggctgaagaccaacggcgccgtgaacggcaagggcagcctgaagggccagcccggcgacatctaccaccagacctgggccagatacttcgtgaagttcctggacgcctacgccgagcacaagctgcagttctgggccgtgaccgccgagaacgagcccagcgccggcctgctgagcggctaccccttccagtgcctgggcttcacccccgagcaccagagagacttcatcgccagagacctgggccccaccctggccaacagcacccaccacaacgtgagactgctgatgctggacgaccagagactgctgctgccccactgggccaaggtggtgctgaccgaccccgaggccgccaagtacgtgcacggcatcgccgtgcactggtacctggacttcctggcccccgccaaggccaccctgggcgagacccacagactgttccccaacaccatgctgttcgccagcgaggcctgcgtgggcagcaagttctgggagcagagcgtgagactgggcagctgggacagaggcatgcagtacagccacagcatcatcaccaacctgctgtaccacgtggtgggctggaccgactggaacctggccctgaaccccgagggcggccccaactgggtgagaaacttcgtggacagccccatcatcgtggacatcaccaaggacaccttctacaagcagcccatgttctaccacctgggccacttcagcaagttcatccccgagggcagccagagagtgggcctggtggccagccagaagaacgacctggacgccgtggccctgatgcaccccgacggcagcgccgtggtggtggtgctgaacagaagcagcaaggacgtgcccctgaccatcaaggaccccgccgtgggcttcctggagaccatcagccccggctacagcatccacacctacctgtggagaagacagtag

SEQ ID NO: 1924 - DNA, 1272 bp, Artificial Sequence
  Description of Artificial Sequence: Synthetic coding sequence
atggagttcagcagccccagcagagaggagtgccccaagcccctgagcagagtgagcatcatggccggcagcctgaccggcctgctgctgctgcaggccgtgagctgggccagcggcatcggctacaacatcatcagagtgcccatggccagctgcgacttcagcatcagaacctacacctacgccgacacccccgacgacttccagctgcacaacttcagcctgcccgaggaggacaccaagctgaagatccccctgatccacagagccctgcagctggcccagagacccgtgagcctgctggccagcccctggaccagccccacctggctgaagaccaacggcgccgtgaacggcaagggcagcctgaagggccagcccggcgacatctaccaccagacctgggccagatacttcgtgaagttcctggacgcctacgccgagcacaagctgcagttctgggccgtgaccgccgagaacgagcccagcgccggcctgctgagcggctaccccttccagtgcctgggcttcacccccgagcaccagagagacttcatcgccagagacctgggccccaccctggccaacagcacccaccacaacgtgagactgctgatgctggacgaccagagactgctgctgccccactgggccaaggtggtgctgaccgaccccgaggccgccaagtacgtgcacggcatcgccgtgcactggtacctggacttcctggcccccgccaaggccaccctgggcgagacccacagactgttccccaacaccatgctgttcgccagcgaggcctgcgtgggcagcaagttctgggagcagagcgtgagactgggcagctgggacagaggcatgcagtacagccacagcatcatcaccaacctgctgtaccacgtggtgggctggaccgactggaacctggccctgaaccccgagggcggccccaactgggtgagaaacttcgtggacagccccatcatcgtggacatcaccaaggacaccttctacaagcagcccatgttctaccacctgggccacttcagcaagttcatccccgagggcagccagagagtgggcctggtggccagccagaagaacgacctggacgccgtggccctgatgcaccccgacggcagcgccgtggtggtggtgctgaacagaagcagcaaggacgtgcccctgaccatcaaggaccccgccgtgggcttcctggagaccatcagccccggctacagcatccacacctacctgtggagaagacagtag

SEQ ID NO: 1925 - DNA, 2112 bp, Artificial Sequence
  Description of Artificial Sequence: Synthetic coding sequence
atgctgagaggcagaagcctgagcgtgaccagcctgggcggcctgccccagtgggaggtggaggagctgcccgtggaggagctgctgctgttcgaggtggcctgggaggtgaccaacaaggtgggcggcatctacaccgtgatccagaccaaggccaagaccaccgccgacgagtggggcgagaactacttcctgatcggcccctacttcgagcacaacatgaagacccaggtggagcagtgcgagcccgtgaacgacgccgtgagaagagccgtggacgccatgaacaagcacggctgccaggtgcacttcggcagatggctgatcgagggcagcccctacgtggtgctgttcgacatcggctacagcgcctggaacctggacagatggaagggcgacctgtgggaggcctgcagcgtgggcatcccctaccacgacagagaggccaacgacatgctgatcttcggcagcctgaccgcctggttcctgaaggaggtgaccgaccacgccgacggcaagtacgtggtggcccagttccacgagtggcaggccggcatcggcctgatcctgagcagagccagaaagctgcccatcgccaccatcttcaccacccacgccaccctgctgggcagatacctgtgcgccgccaacatcgacttctacaaccacctggacaagttcaacatcgacaaggaggccggcgagagacagatctaccacagatactgcatggagagagccagcgtgcactgcgcccacgtgttcaccaccgtgagcgagatcaccgccatcgaggccgagcacatgctgaagagaaagcccgacgtggtgacccccaacggcctgaacgtgaagaagttcagcgccgtgcacgagttccagaacctgcacgccatgtacaaggccagaatccaggacttcgtgagaggccacttctacggccacctggacttcgacctggagaagaccctgttcctgttcatcgccggcagatacgagttcagcaacaagggcgccgacatcttcctggagagcctgagcagactgaacttcctgctgagaatgcacaagagcgacatcaccgtgatggtgttcttcatcatgcccgccaagaccaacaacttcaacgtggagaccctgaagggccaggccgtgagaaagcagctgtgggacgtggcccacagcgtgaaggagaagttcggcaagaagctgtacgacgccctgctgagaggcgagatccccgacctgaacgacatcctggacagagacgacctgaccatcatgaagagagccatcttcagcacccagagacagagcctgccccccgtgaccacccacaacatgatcgacgacagcaccgaccccatcctgagcaccatcagaagaatcggcctgttcaacaacagaaccgacagagtgaaggtgatcctgcaccccgagttcctgagcagcaccagccccctgctgcccatggactacgaggagttcgtgagaggctgccacctgggcgtgttccccagctactacgagccctggggctacacccccgccgagtgcaccgtgatgggcatccccagcgtgaccaccaacctgagcggcttcggctgcttcatgcaggagcacgtggccgaccccaccgcctacggcatctacatcgtggacagaagattcagaagccccgacgacagctgcaaccagctgaccaagttcctgtacggcttctgcaagcagagcagaagacagagaatcatccagagaaacagaaccgagagactgagcgacctgctggactggagatacctgggcagatactaccagcacgccagacacctgaccctgagcagagccttccccgacaagttccacgtggagctgaccagcccccccaccaccgagggcttcaagtaccccagacccagcagcgtgccccccagccccagcggcagccaggccagcagcccccagagcagcgacgtggaggacgaggtggaggacgagagatacgacgaggaggaggaggccgagagagacagactgaacatcaagagccccttcagcctgagccacgtgccccacggcaagaagaagctgcacggcgagtacaagaactag

SEQ ID NO: 1926 - DNA, 351 bp, Artificial Sequence
  Description of Artificial Sequence: Synthetic coding sequence
atggactactacagaaagtacgccgccatcttcctggtgaccctgagcgtgttcctgcacgtgctgcacagcgcccccgacgtgcaggactgccccgagtgcaccctgcaggagaaccccttcttcagccagcccggcgcccccatcctgcagtgcatgggctgctgcttcagcagagcctaccccacccccctgagaagcaagaagaccatgctggtgcagaagaacgtgaccagcgagagcacctgctgcgtggccaagagctacaacagagtgaccgtgatgggcggcttcaaggtggagaaccacaccgcctgccactgcagcacctgctactaccacaagagctag

SEQ ID NO: 1927 - DNA, 654 bp, Artificial Sequence
  Description of Artificial Sequence: Synthetic coding sequence
atggccaccggcagcagaaccagcctgctgctggccttcggcctgctgtgcctgccctggctgcaggagggcagcgccttccccaccatccccctgagcagactgttcgacaacgccatgctgagagcccacagactgcaccagctggccttcgacacctaccaggagttcgaggaggcctacatccccaaggagcagaagtacagcttcctgcagaacccccagaccagcctgtgcttcagcgagagcatccccacccccagcaacagagaggagacccagcagaagagcaacctggagctgctgagaatcagcctgctgctgatccagagctggctggagcccgtgcagttcctgagaagcgtgttcgccaacagcctggtgtacggcgccagcgacagcaacgtgtacgacctgctgaaggacctggaggagggcatccagaccctgatgggcagactggaggacggcagccccagaaccggccagatcttcaagcagacctacagcaagttcgacaccaacagccacaacgacgacgccctgctgaagaactacggcctgctgtactgcttcagaaaggacatggacaaggtggagaccttcctgagaatcgtgcagtgcagaagcgtggagggcagctgcggcttctag

SEQ ID NO: 1928 - DNA, 369 bp, Artificial Sequence
  Description of Artificial Sequence: Synthetic coding sequence
atggccaccggcagcagaaccagcctgctgctggccttcggcctgctgtgcctgccctggctgcaggagggcagcgccttccccaccatccccctgagcagactgttcgacaacgccatgctgagagcccacagactgcaccagctggccttcgacacctaccaggagttcagactggaggacggcagccccagaaccggccagatcttcaagcagacctacagcaagttcgacaccaacagccacaacgacgacgccctgctgaagaactacggcctgctgtactgcttcagaaaggacatggacaaggtggagaccttcctgagaatcgtgcagtgcagaagcgtggagggcagctgcggcttctag

SEQ ID NO: 1929 - DNA, 534 bp, Artificial Sequence
  Description of Artificial Sequence: Synthetic coding sequence
atggccaccggcagcagaaccagcctgctgctggccttcggcctgctgtgcctgccctggctgcaggagggcagcgccttccccaccatccccctgagcagactgttcgacaacgccatgctgagagcccacagactgcaccagctggccttcgacacctaccaggagttcaacctggagctgctgagaatcagcctgctgctgatccagagctggctggagcccgtgcagttcctgagaagcgtgttcgccaacagcctggtgtacggcgccagcgacagcaacgtgtacgacctgctgaaggacctggaggagggcatccagaccctgatgggcagactggaggacggcagccccagaaccggccagatcttcaagcagacctacagcaagttcgacaccaacagccacaacgacgacgccctgctgaagaactacggcctgctgtactgcttcagaaaggacatggacaaggtggagaccttcctgagaatcgtgcagtgcagaagcgtggagggcagctgcggcttctag

SEQ ID NO: 1930 - DNA, 609 bp, Artificial Sequence
  Description of Artificial Sequence: Synthetic coding sequence
atggccaccggcagcagaaccagcctgctgctggccttcggcctgctgtgcctgccctggctgcaggagggcagcgccttccccaccatccccctgagcagactgttcgacaacgccatgctgagagcccacagactgcaccagctggccttcgacacctaccaggagttcaacccccagaccagcctgtgcttcagcgagagcatccccacccccagcaacagagaggagacccagcagaagagcaacctggagctgctgagaatcagcctgctgctgatccagagctggctggagcccgtgcagttcctgagaagcgtgttcgccaacagcctggtgtacggcgccagcgacagcaacgtgtacgacctgctgaaggacctggaggagggcatccagaccctgatgggcagactggaggacggcagccccagaaccggccagatcttcaagcagacctacagcaagttcgacaccaacagccacaacgacgacgccctgctgaagaactacggcctgctgtactgcttcagaaaggacatggacaaggtggagaccttcctgagaatcgtgcagtgcagaagcgtggagggcagctgcggcttctag

SEQ ID NO: 1931 - DNA, 771 bp, Artificial Sequence
  Description of Artificial Sequence: Synthetic coding sequence
atggccgccggcagcagaaccagcctgctgctggccttcggcctgctgtgcctgagctggctgcaggagggcagcgccttccccaccatccccctgagcagactgttcgacaacgccatgctgagagccagaagactgtaccagctggcctacgacacctaccaggagttcgaggaggcctacatcctgaaggagcagaagtacagcttcctgcagaacccccagaccagcctgtgcttcagcgagagcatccccacccccagcaacagagtgaagacccagcagaagagcaacctggagctgctgagaatcagcctgctgctgatccagagctggctggagcccgtgcagctgctgagaagcgtgttcgccaacagcctggtgtacggcgccagcgacagcaacgtgtacagacacctgaaggacctggaggagggcatccagaccctgatgtgggtgagagtggcccccggcatccccaaccccggcgcccccctggccagcagagactggggcgagaagcactgctgccccctgttcagcagccaggccctgacccaggagaacagcccctacagcagcttccccctggtgaacccccccggcctgagcctgcagcccggcggcgagggcggcaagtggatgaacgagagaggcagagagcagtgccccagcgcctggcccctgctgctgttcctgcacttcgccgaggccggcagatggcagccccccgactgggccgacctgcagagcgtgctgcagcaggtgtag

SEQ ID NO: 1932 - DNA, 654 bp, Artificial Sequence
  Description of Artificial Sequence: Synthetic coding sequence
atggccgccggcagcagaaccagcctgctgctggccttcggcctgctgtgcctgagctggctgcaggagggcagcgccttccccaccatccccctgagcagactgttcgacaacgccatgctgagagccagaagactgtaccagctggcctacgacacctaccaggagttcgaggaggcctacatcctgaaggagcagaagtacagcttcctgcagaacccccagaccagcctgtgcttcagcgagagcatccccacccccagcaacagagtgaagacccagcagaagagcaacctggagctgctgagaatcagcctgctgctgatccagagctggctggagcccgtgcagctgctgagaagcgtgttcgccaacagcctggtgtacggcgccagcgacagcaacgtgtacagacacctgaaggacctggaggagggcatccagaccctgatgtggagactggaggacggcagccccagaaccggccagatcttcaaccagagctacagcaagttcgacaccaagagccacaacgacgacgccctgctgaagaactacggcctgctgtactgcttcagaaaggacatggacaaggtggagaccttcctgagaatcgtgcagtgcagaagcgtggagggcagctgcggcttctag

SEQ ID NO: 1933 - DNA, 609 bp, Artificial Sequence
  Description of Artificial Sequence: Synthetic coding sequence
atggccgccggcagcagaaccagcctgctgctggccttcggcctgctgtgcctgagctggctgcaggagggcagcgccttccccaccatccccctgagcagactgttcgacaacgccatgctgagagccagaagactgtaccagctggcctacgacacctaccaggagttcaacccccagaccagcctgtgcttcagcgagagcatccccacccccagcaacagagtgaagacccagcagaagagcaacctggagctgctgagaatcagcctgctgctgatccagagctggctggagcccgtgcagctgctgagaagcgtgttcgccaacagcctggtgtacggcgccagcgacagcaacgtgtacagacacctgaaggacctggaggagggcatccagaccctgatgtggagactggaggacggcagccccagaaccggccagatcttcaaccagagctacagcaagttcgacaccaagagccacaacgacgacgccctgctgaagaactacggcctgctgtactgcttcagaaaggacatggacaaggtggagaccttcctgagaatcgtgcagtgcagaagcgtggagggcagctgcggcttctag

SEQ ID NO: 1934 - DNA, 738 bp, Artificial Sequence
  Description of Artificial Sequence: Synthetic coding sequence
atggccgccggcagcagaaccagcctgctgctggccttcggcctgctgtgcctgagctggctgcaggagggcagcgccttccccaccatccccctgagcagactgttcgacaacgccatgctgagagccagaagactgtaccagctggcctacgacacctaccaggagttcgaggaggcctacatcctgaaggagcagaagtacagcttcctgcagaacccccagaccagcctgtgcttcagcgagagcatccccacccccagcaacagagtgaagacccagcagaagagcaacctggagctgctgagaatcagcctgctgctgatccagagctggctggagcccgtgcagctgctgagaagcgtgttcgccaacagcctggtgtacggcgccagcgacagcaacgtgtacagacacctgaaggacctggaggagggcatccagaccctgatcggctggaagatggccgcccccggcctgggcagaagcagcatcagccccaccgccagcctgacccagaacagaaccaccatgacccactgcagcagaaccaccggctgcagcaccgccagcggcagaacctggaccagaagcagacacagctgcgccagctgcagcgccgccctgtggagagccgccgtggccagcagctgccccggcggcatccccgtgacccccccccagtgcctgagctggagctggaaggtgctgctgcagtgcccccccgccctgagctag

SEQ ID NO: 1935 - DNA, 753 bp, Artificial Sequence
  Description of Artificial Sequence: Synthetic coding sequence
atggagaagggccccgtgagagcccccgccgagaagcccagaggcgccagatgcagcaacggcttccccgagagagacccccccagacccggccccagcagacccgccgagaagccccccagacccgaggccaagagcgcccagcccgccgacggctggaagggcgagagacccagaagcgaggaggacaacgagctgaacctgcccaacctggccgccgcctacagcagcatcctgagcagcctgggcgagaacccccagagacagggcctgctgaagaccccctggagagccgccagcgccatgcagttcttcaccaagggctaccaggagaccatcagcgacgtgctgaacgacgccatcttcgacgaggaccacgacgagatggtgatcgtgaaggacatcgacatgttcagcatgtgcgagcaccacctggtgcccttcgtgggcaaggtgcacatcggctacctgcccaacaagcaggtgctgggcctgagcaagctggccagaatcgtggagatctacagcagaagactgcaggtgcaggagagactgaccaagcagatcgccgtggccatcaccgaggccctgagacccgccggcgtgggcgtggtggtggaggccacccacatgtgcatggtgatgagaggcgtgcagaagatgaacagcaagaccgtgaccagcaccatgctgggcgtgttcagagaggaccccaagaccagagaggagttcctgaccctgatcagaagctag

SEQ ID NO: 1936 - DNA, 693 bp, Artificial Sequence
  Description of Artificial Sequence: Synthetic coding sequence
atggagaagggccccgtgagagcccccgccgagaagcccagaggcgccagatgcagcaacggcttccccgagagagacccccccagacccggccccagcagacccgccgagaagccccccagacccgaggccaagagcgcccagcccgccgacggctggaagggcgagagacccagaagcgaggaggacaacgagctgaacctgcccaacctggccgccgcctacagcagcatcctgagcagcctgggcgagaacccccagagacagggcctgctgaagaccccctggagagccgccagcgccatgcagttcttcaccaagggctaccaggagaccatcagcgacgtgctgaacgacgccatcttcgacgaggaccacgacgagatggtgatcgtgaaggacatcgacatgttcagcatgtgcgagcaccacctggtgcccttcgtgggcaaggtgcacatcggctacctgcccaacaagcaggtgctgggcctgagcaagctggccagaatcgtggagatctacagcagaagactgcaggtgcaggagagactgaccaagcagatcgccgtggccatcaccgaggccctgagacccgccggcgtgggcgtggtggtggaggccaccaagagcaacaagtacaacaagggcctgagctacttcctgctggccaccttcctgtggcagtactag

SEQ ID NO: 1937 - DNA, 753 bp, Artificial Sequence; identical to SEQ ID NO: 1935
  Description of Artificial Sequence: Synthetic coding sequence

SEQ ID NO: 1938 - DNA, 642 bp, Artificial Sequence
  Description of Artificial Sequence: Synthetic coding sequence
atggagaagggccccgtgagagcccccgccgagaagcccagaggcgccagatgcagcaacggcttccccgagagagacccccccagacccggccccagcagacccgccgagaagccccccagacccgaggccaagagcgcccagcccgccgacggctggaagggcgagagacccagaagcgaggaggacaacgagctgaacctgcccaacctggccgccgcctacagcagcatcctgagcagcctgggcgagaacccccagagacagggcctgctgaagaccccctggagagccgccagcgccatgcagttcttcaccaagggctaccaggagaccatcagcgacgtgctgaacgacgccatcttcgacgaggaccacgacgagatggtgatcgtgaaggacatcgacatgttcagcatgtgcgagcaccacctggtgcccttcgtgggcaaggtgcacatcggctacctgcccaacaagcaggtgctgggcctgagcaagctggccagaatcgtggagatctacagcagaagactgcaggtgcaggagagactgaccaagcagatcgccgtggccatcaccgaggccctgagacccgccggcgtgggcgtggtggtggaggccaccagcgccgagccctag

SEQ ID NO: 1939 - DNA, 702 bp, Artificial Sequence
  Description of Artificial Sequence: Synthetic coding sequence
atggagaagggccccgtgagagcccccgccgagaagcccagaggcgccagatgcagcaacggcttccccgagagagacccccccagacccggccccagcagacccgccgagaagccccccagacccgaggccaagagcgcccagcccgccgacggctggaagggcgagagacccagaagcgaggaggacaacgagctgaacctgcccaacctggccgccgcctacagcagcatcctgagcagcctgggcgagaacccccagagacagggcctgctgaagaccccctggagagccgccagcgccatgcagttcttcaccaagggctaccaggagaccatcagcgacgtgctgaacgacgccatcttcgacgaggaccacgacgagatggtgatcgtgaaggacatcgacatgttcagcatgtgcgagcaccacctggtgcccttcgtgggcaaggtgcacatcggctacctgcccaacaagcaggtgctgggcctgagcaagctggccagaatcgtggagatctacagcagaagactgcaggtgcaggagagactgaccaagcagatcgccgtggccatcaccgaggccctgagacccgccggcgtgggcgtggtggtggaggccaccaagagcaacaagtacaacaagggcctgagccccctgctgagcagctgccacctgttcgtggccatcctgaagtag

SEQ ID NO: 1940 - DNA, 1014 bp, Artificial Sequence
  Description of Artificial Sequence: Synthetic coding sequence
atgggccccagagccagacccgccctgctgctgctgatgctgctgcagaccgccgtgctgcagggcagactgctgagaagccacagcctgcactacctgttcatgggcgccagcgagcaggacctgggcctgagcctgttcgaggccctgggctacgtggacgaccagctgttcgtgttctacgaccacgagagcagaagagtggagcccagaaccccctgggtgagcagcagaatcagcagccagatgtggctgcagctgagccagagcctgaagggctgggaccacatgttcaccgtggacttctggaccatcatggagaaccacaaccacagcaaggagagccacaccctgcaggtgatcctgggctgcgagatgcaggaggacaacagcaccgagggctactggaagtacggctacgacggccaggaccacctggagttctgccccgacaccctggactggagagccgccgagcccagagcctggcccaccaagctggagtgggagagacacaagatcagagccagacagaacagagcctacctggagagagactgccccgcccagctgcagcagctgctggagctgggcagaggcgtgctggaccagcaggtgccccccctggtgaaggtgacccaccacgtgaccagcagcgtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagcttctag

SEQ ID NO: 1941 - DNA, 771 bp, Artificial Sequence
  Description of Artificial Sequence: Synthetic coding sequence
atgggccccagagccagacccgccctgctgctgctgatgctgctgcagaccgccgtgctgcagggcagactgctgagaagccacagcctgcactacctgttcatgggcgccagcgagcaggacctgggcctgagcctgttcgaggccctgggctacgtggacgaccagctgttcgtgttctacgaccacgagagcagaagagtggagcccagaaccccctgggtgagcagcagaatcagcagccagatgtggctgcagctgagccagagcctgaagggctgggaccacatgttcaccgtggacttctggaccatcatggagaaccacaaccacagcaaggtgccccccctggtgaaggtgacccaccacgtgaccagcagcgtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1942 - DNA, 729 bp, Artificial Sequence
  Description of Artificial Sequence: Synthetic coding sequence
atgggccccagagccagacccgccctgctgctgctgatgctgctgcagaccgccgtgctgcagggcagactgctgagaagccacagcctgcactacctgttcatgggcgccagcgagcaggacctgggcctgagcctgttcgaggccctgggctacgtggacgaccagctgttcgtgttctacgaccacgagagcagaagagtggagcccagaaccccctgggtgagcagcagaatcagcagccagatgtggctgcagctgagccagagcctgaagggctgggaccacatgttcaccgtggacttctggaccatcatggagaaccacaaccacagcaaggtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1943 - DNA, 783 bp, Artificial Sequence
  Description of Artificial Sequence: Synthetic coding sequence
atgggccccagagccagacccgccctgctgctgctgatgctgctgcagaccgccgtgctgcagggcagactgctgcagagccacaccctgcaggtgatcctgggctgcgagatgcaggaggacaacagcaccgagggctactggaagtacggctacgacggccaggaccacctggagttctgccccgacaccctggactggagagccgccgagcccagagcctggcccaccaagctggagtgggagagacacaagatcagagccagacagaacagagcctacctggagagagactgccccgcccagctgcagcagctgctggagctgggcagaggcgtgctggaccagcaggtgccccccctggtgaaggtgacccaccacgtgaccagcagcgtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1944 - DNA, 231 bp, Artificial Sequence
  Description of Artificial Sequence: Synthetic coding sequence
atgggccccagagccagacccgccctgctgctgctgatgctgctgcagaccgccgtgctgcagggcagactgctgcagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1945 - DNA, 507 bp, Artificial Sequence
  Description of Artificial Sequence: Synthetic coding sequence
atgggccccagagccagacccgccctgctgctgctgatgctgctgcagaccgccgtgctgcagggcagactgctgctgccccccctggtgaaggtgacccaccacgtgaccagcagcgtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1946 - DNA, 1047 bp, Artificial Sequence
  Description of Artificial Sequence: Synthetic coding sequence
atgggccccagagccagacccgccctgctgctgctgatgctgctgcagaccgccgtgctgcagggcagactgctgagaagccacagcctgcactacctgttcatgggcgccagcgagcaggacctgggcctgagcctgttcgaggccctgggctacgtggacgaccagctgttcgtgttctacgaccacgagagcagaagagtggagcccagaaccccctgggtgagcagcagaatcagcagccagatgtggctgcagctgagccagagcctgaagggctgggaccacatgttcaccgtggacttctggaccatcatggagaaccacaaccacagcaaggagagccacaccctgcaggtgatcctgggctgcgagatgcaggaggacaacagcaccgagggctactggaagtacggctacgacggccaggaccacctggagttctgccccgacaccctggactggagagccgccgagcccagagcctggcccaccaagctggagtgggagagacacaagatcagagccagacagaacagagcctacctggagagagactgccccgcccagctgcagcagctgctggagctgggcagaggcgtgctggaccagcaggtgccccccctggtgaaggtgacccaccacgtgaccagcagcgtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1947 - DNA, 978 bp, Artificial Sequence
  Description of Artificial Sequence: Synthetic coding sequence
atgggccccagagccagacccgccctgctgctgctgatgctgctgcagaccgccgtgctgcagggcagactgctgcccctgggctacgtggacgaccagctgttcgtgttctacgaccacgagagcagaagagtggagcccagaaccccctgggtgagcagcagaatcagcagccagatgtggctgcagctgagccagagcctgaagggctgggaccacatgttcaccgtggacttctggaccatcatggagaaccacaaccacagcaaggagagccacaccctgcaggtgatcctgggctgcgagatgcaggaggacaacagcaccgagggctactggaagtacggctacgacggccaggaccacctggagttctgccccgacaccctggactggagagccgccgagcccagagcctggcccaccaagctggagtgggagagacacaagatcagagccagacagaacagagcctacctggagagagactgccccgcccagctgcagcagctgctggagctgggcagaggcgtgctggaccagcaggtgccccccctggtgaaggtgacccaccacgtgaccagcagcgtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1948 - DNA, 1005 bp, Artificial Sequence
  Description of Artificial Sequence: Synthetic coding sequence
atgggccccagagccagacccgccctgctgctgctgatgctgctgcagaccgccgtgctgcagggcagactgctgagaagccacagcctgcactacctgttcatgggcgccagcgagcaggacctgggcctgagcctgttcgaggccctgggctacgtggacgaccagctgttcgtgttctacgaccacgagagcagaagagtggagcccagaaccccctgggtgagcagcagaatcagcagccagatgtggctgcagctgagccagagcctgaagggctgggaccacatgttcaccgtggacttctggaccatcatggagaaccacaaccacagcaaggagagccacaccctgcaggtgatcctgggctgcgagatgcaggaggacaacagcaccgagggctactggaagtacggctacgacggccaggaccacctggagttctgccccgacaccctggactggagagccgccgagcccagagcctggcccaccaagctggagtgggagagacacaagatcagagccagacagaacagagcctacctggagagagactgccccgcccagctgcagcagctgctggagctgggcagaggcgtgctggaccagcaggtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1949 - DNA, 1038 bp, Artificial Sequence
  Description of Artificial Sequence: Synthetic coding sequence
atgggccccagagccagacccgccctgctgctgctgatgctgctgcagaccgccgtgctgcagggcagactgctgagaagccacagcctgcactacctgttcatgggcgccagcgagcaggacctgggcctgagcctgttcgaggccctgggctacgtggacgaccagctgttcgtgttctacgaccacgagagcagaagagtggagcccagaaccccctgggtgagcagcagaatcagcagccagatgtggctgcagctgagccagagcctgaagggctgggaccacatgttcaccgtggacttctggaccatcatggagaaccacaaccacagcaaggagagccacaccctgcaggtgatcctgggctgcgagatgcaggaggacaacagcaccgagggctactggaagtacggctacgacggccaggaccacctggagttctgccccgacaccctggactggagagccgccgagcccagagcctggcccaccaagctggagtgggagagacacaagatcagagccagacagaacagagcctacctggagagagactgccccgcccagctgcagcagctgctggagctgggcagaggcgtgctggaccagcaggagggcagcgagagcagcagcctgcccggcaaggtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1950 - DNA, 741 bp, Artificial Sequence
  Description of Artificial Sequence: Synthetic coding sequence
atgggccccagagccagacccgccctgctgctgctgatgctgctgcagaccgccgtgctgcagggcagactgctgcagagccacaccctgcaggtgatcctgggctgcgagatgcaggaggacaacagcaccgagggctactggaagtacggctacgacggccaggaccacctggagttctgccccgacaccctggactggagagccgccgagcccagagcctggcccaccaagctggagtgggagagacacaagatcagagccagacagaacagagcctacctggagagagactgccccgcccagctgcagcagctgctggagctgggcagaggcgtgctggaccagcaggtgaccaccctgagatgcagagccctgaactactacccccagaacatcaccatgaagtggctgaaggacaagcagcccatggacgccaaggagttcgagcccaaggacgtgctgcccaacggcgacggcacctaccagggctggatcaccctggccgtgccccccggcgaggagcagagatacacctgccaggtggagcaccccggcctggaccagcccctgatcgtgatctgggagcccagccccagcggcaccctggtgatcggcgtgatcagcggcatcgccgtgttcgtggtgatcctgttcatcggcatcctgttcatcatcctgagaaagagacagggcagcagaggcgccatgggccactacgtgctggccgagagagagtag

SEQ ID NO: 1951 - DNA, 486 bp, Artificial Sequence
  Description of Artificial Sequence: Synthetic coding sequence
atgggccccagagccagacccgccctgctgctgctgatgctgctgcagaccgccgtgctgcagggcagactgctgagaagccacagcctgcactacctgttcatgggcgccagcgagcaggacctgggcctgagcctgttcgaggccctgggctacgtggacgaccagctgttcgtgttctacgaccacgagagcagaagagtggagcccagaaccccctgggtgagcagcagaatcagcagccagatgtggctgcagctgagccagagcctgaagggctgggaccacatgttcaccgtggacttctggaccatcatggagaaccacaaccacagcaaggagagccacaccctgcaggtgatcctgggctgcgagatgcaggaggacaacagcaccgagggctactggaagtacggctacgacggccaggtgctgcaggacaccatctacagcagcgaggtgagcagcctgggcatcaagttctag

SEQ ID NO: 1952 - DNA, 366 bp, Artificial Sequence
  Description of Artificial Sequence: Synthetic coding sequence
atggagaaccacaaccacagcaaggagagccacaccctgcaggtgatcctgggctgcgagatgcaggaggacaacagcaccgagggctactggaagtacggctacgacggccaggaccacctggagttctgccccgacaccctggactggagagccgccgagcccagagcctggcccaccaagctggagtgggagagacacaagatcagagccagacagaacagagcctacctggagagagactgccccgcccagctgcagcagctgctggagctgggcagaggcgtgctggaccagcaggtgccccccctggtgaaggtgacccaccacgtgagccaccccgcccagcccagcaaggagagctag

SEQ ID NO: 1953 - DNA, 1281 bp, Artificial Sequence
  Description of Artificial Sequence: Synthetic coding sequence
atgggcgagcccggccagagccccagccccagaagcagccacggcagcccccccaccctgagcaccctgaccctgctgctgctgctgtgcggccacgcccacagccagtgcaagatcctgagatgcaacgccgagtacgtgagcagcaccctgagcctgagaggcggcggcagcagcggcgccctgagaggcggcggcggcggcggcagaggcggcggcgtgggcagcggcggcctgtgcagagccctgagaagctacgccctgtgcaccagaagaaccgccagaacctgcagaggcgacctggccttccacagcgccgtgcacggcatcgaggacctgatgatccagcacaactgcagcagacagggccccaccgccccccccccccccagaggccccgccctgcccggcgccggcagcggcctgcccgcccccgacccctgcgactacgagggcagattcagcagactgcacggcagaccccccggcttcctgcactgcgccagcttcggcgacccccacgtgagaagcttccaccaccacttccacacctgcagagtgcagggcgcctggcccctgctggacaacgacttcctgttcgtgcaggccaccagcagccccatggccctgggcgccaacgccaccgccaccagaaagctgaccatcatcttcaagaacatgcaggagtgcatcgaccagaaggtgtaccaggccgaggtggacaacctgcccgtggccttcgaggacggcagcatcaacggcggcgacagacccggcggcagcagcctgagcatccagaccgccaaccccggcaaccacgtggagatccaggccgcctacatcggcaccaccatcatcatcagacagaccgccggccagctgagcttcagcatcaaggtggccgaggacgtggccatggccttcagcgccgagcaggacctgcagctgtgcgtgggcggctgcccccccagccagagactgagcagaagcgagagaaacagaagaggcgccatcaccatcgacaccgccagaagactgtgcaaggagggcctgcccgtggaggacgcctacttccacagctgcgtgttcgacgtgctgatcagcggcgaccccaacttcaccgtggccgcccaggccgccctggaggacgccagagccttcctgcccgacctggagaagctgcacctgttccccagcgacgccggcgtgcccctgagcagcgccaccctgctggcccccctgctgagcggcctgttcgtgctgtggctgtgcatccagtag

SEQ ID NO: 1954 - DNA, 942 bp, Artificial Sequence
  Description of Artificial Sequence: Synthetic coding sequence
atgatccagcacaactgcagcagacagggccccaccgccccccccccccccagaggccccgccctgcccggcgccggcagcggcctgcccgcccccgacccctgcgactacgagggcagattcagcagactgcacggcagaccccccggcttcctgcactgcgccagcttcggcgacccccacgtgagaagcttccaccaccacttccacacctgcagagtgcagggcgcctggcccctgctggacaacgacttcctgttcgtgcaggccaccagcagccccatggccctgggcgccaacgccaccgccaccagaaagctgaccatcatcttcaagaacatgcaggagtgcatcgaccagaaggtgtaccaggccgaggtggacaacctgcccgtggccttcgaggacggcagcatcaacggcggcgacagacccggcggcagcagcctgagcatccagaccgccaaccccggcaaccacgtggagatccaggccgcctacatcggcaccaccatcatcatcagacagaccgccggccagctgagcttcagcatcaaggtggccgaggacgtggccatggccttcagcgccgagcaggacctgcagctgtgcgtgggcggctgcccccccagccagagactgagcagaagcgagagaaacagaagaggcgccatcaccatcgacaccgccagaagactgtgcaaggagggcctgcccgtggaggacgcctacttccacagctgcgtgttcgacgtgctgatcagcggcgaccccaacttcaccgtggccgcccaggccgccctggaggacgccagagccttcctgcccgacctggagaagctgcacctgttccccagcgacgccggcgtgcccctgagcagcgccaccctgctggcccccctgctgagcggcctgttcgtgctgtggctgtgcatccagtag

SEQ ID NO: 1955 - DNA, 282 bp, Artificial Sequence
  Description of Artificial Sequence: Synthetic coding sequence
atgggcgagcccggccagagccccagccccagaagcagccacggcagcccccccaccctgagcaccctgaccctgctgctgctgctgtgcggccacgcccacagccagtgcaagatcctgagatgcaacgccgagtacgtgagcagcaccctgagcctgagaggcggcggcagcagcggcgccctgagaggcggcggcggcggcggcagaggcggcggcgtgggcagcggcggcctgtgcagagccctgagaagctacgccctgtgcaccagaagaacctag

SEQ ID NO: 1956 - DNA, 603 bp, Artificial Sequence
  Description of Artificial Sequence: Synthetic coding sequence
atgcaggagtgcatcgaccagaaggtgtaccaggccgaggtggacaacctgcccgtggccttcgaggacggcagcatcaacggcggcgacagacccggcggcagcagcctgagcatccagaccgccaaccccggcaaccacgtggagatccaggccgcctacatcggcaccaccatcatcatcagacagaccgccggccagctgagcttcagcatcaaggtggccgaggacgtggccatggccttcagcgccgagcaggacctgcagctgtgcgtgggcggctgcccccccagccagagactgagcagaagcgagagaaacagaagaggcgccatcaccatcgacaccgccagaagactgtgcaaggagggcctgcccgtggaggacgcctacttccacagctgcgtgttcgacgtgctgatcagcggcgaccccaacttcaccgtggccgcccaggccgccctggaggacgccagagccttcctgcccgacctggagaagctgcacctgttccccagcgacgccggcgtgcccctgagcagcgccaccctgctggcccccctgctgagcggcctgttcgtgctgtggctgtgcatccagtag

SEQ ID NO: 1957 - DNA, 603 bp, Artificial Sequence; identical to SEQ ID NO: 1956
  Description of Artificial Sequence: Synthetic coding sequence

SEQ ID NO: 1958 - DNA, 603 bp, Artificial Sequence; identical to SEQ ID NO: 1956
  Description of Artificial Sequence: Synthetic coding sequence

SEQ ID NO: 1959 - DNA, 603 bp, Artificial Sequence; identical to SEQ ID NO: 1956
  Description of Artificial Sequence: Synthetic coding sequence

SEQ ID NO: 1960 - DNA, 1905 bp, Artificial Sequence
  Description of Artificial Sequence: Synthetic coding sequence
atgcccagcgacctggccaagaagaaggccgccaagaagaaggaggccgccaaggccagacagagacccagaaagggccacgaggagaacggcgacgtggtgaccgagccccaggtggccgagaagaacgaggccaacggcagagagaccaccgaggtggacctgctgaccaaggagctggaggacttcgagatgaagaaggccgccgccagagccgtgaccggcgtgctggccagccaccccaacagcaccgacgtgcacatcatcaacctgagcctgaccttccacggccaggagctgctgagcgacaccaagctggagctgaacagcggcagaagatacggcctgatcggcctgaacggcatcggcaagagcatgctgctgagcgccatcggcaagagagaggtgcccatccccgagcacatcgacatctaccacctgaccagagagatgccccccagcgacaagacccccctgcactgcgtgatggaggtggacaccgagagagccatgctggagaaggaggccgagagactggcccacgaggacgccgagtgcgagaagctgatggagctgtacgagagactggaggagctggacgccgacaaggccgagatgagagccagcagaatcctgcacggcctgggcttcacccccgccatgcagagaaagaagctgaaggacttcagcggcggctggagaatgagagtggccctggccagagccctgttcatcagacccttcatgctgctgctggacgagcccaccaaccacctggacctggacgcctgcgtgtggctggaggaggagctgaagaccttcaagagaatcctggtgctggtgagccacagccaggacttcctgaacggcgtgtgcaccaacatcatccacatgcacaacaagaagctgaagtactacaccggcaactacgaccagtacgtgaagaccagactggagctggaggagaaccagatgaagagattccactgggagcaggaccagatcgcccacatgaagaactacatcgccagattcggccacggcagcgccaagctggccagacaggcccagagcaaggagaagaccctgcagaagatgatggccagcggcctgaccgagagagtggtgagcgacaagaccctgagcttctacttccccccctgcggcaagatccccccccccgtgatcatggtgcagaacgtgagcttcaagtacaccaaggacggcccctgcatctacaacaacctggagttcggcatcgacctggacaccagagtggccctggtgggccccaacggcgccggcaagagcaccctgctgaagctgctgaccggcgagctgctgcccaccgacggcatgatcagaaagcacagccacgtgaagatcggcagataccaccagcacctgcaggagcagctggacctggacctgagccccctggagtacatgatgaagtgctaccccgagatcaaggagaaggaggagatgagaaagatcatcggcagatacggcctgaccggcaagcagcaggtgagccccatcagaaacctgagcgacggccagaagtgcagagtgtgcctggcctggctggcctggcagaacccccacatgctgttcctggacgagcccaccaaccacctggacatcgagaccatcgacgccctggccgacgccatcaacgagttcgagggcggcatgatgctggtgagccacgacttcagactgatccagcaggtggcccaggagatctgggtgtgcgagaagcagaccatcaccaagtggcccggcgacatcctggcctacaaggagcacctgaagagcaagctggtggacgaggagccccagctgaccaagagaacccacaacgtgtgcaccctgaccctggccagcctgcccagaccctag

SEQ ID NO: 1961 - DNA, 555 bp, Artificial Sequence
  Description of Artificial Sequence: Synthetic coding sequence
atgtgggtgaccaagctgctgcccgccctgctgctgcagcacgtgctgctgcacctgctgctgctgcccatcgccatcccctacgccgagggccagagaaagagaagaaacaccatccacgagttcaagaagagcgccaagaccaccctgatcaagatcgaccccgccctgaagatcaagaccaagaaggtgaacaccgccgaccagtgcgccaacagatgcaccagaaacaagggcctgcccttcacctgcaaggccttcgtgttcgacaaggccagaaagcagtgcctgtggttccccttcaacagcatgagcagcggcgtgaagaaggagttcggccacgagttcgacctgtacgagaacaaggactacatcagaaactgcatcatcggcaagggcagaagctacaagggcaccgtgagcatcaccaagagcggcatcaagtgccagccctggagcagcatgatcccccacgagcacagcggcggcgacgactgcctggtggagagcaccttctacagcatccccttctggggccacaacagcgccagatag

SEQ ID NO: 1962 - DNA, 891 bp, Artificial Sequence
  Description of Artificial Sequence: Synthetic coding sequence
atgtgggtgaccaagctgctgcccgccctgctgctgcagcacgtgctgctgcacctgctgctgctgcccatcgccatcccctacgccgagggccagagaaagagaagaaacaccatccacgagttcaagaagagcgccaagaccaccctgatcaagatcgaccccgccctgaagatcaagaccaagaaggtgaacaccgccgaccagtgcgccaacagatgcaccagaaacaagggcctgcccttcacctgcaaggccttcgtgttcgacaaggccagaaagcagtgcctgtggttccccttcaacagcatgagcagcggcgtgaagaaggagttcggccacgagttcgacctgtacgagaacaaggactacatcagaaactgcatcatcggcaagggcagaagctacaagggcaccgtgagcatcaccaagagcggcatcaagtgccagccctggagcagcatgatcccccacgagcacagcttcctgcccagcagctacagaggcaaggacctgcaggagaactactgcagaaaccccagaggcgaggagggcggcccctggtgcttcaccagcaaccccgaggtgagatacgaggtgtgcgacatcccccagtgcagcgaggtggagtgcatgacctgcaacggcgagagctacagaggcctgatggaccacaccgagagcggcaagatctgccagagatgggaccaccagaccccccacagacacaagttcctgcccgagagataccccgacaagggcttcgacgacaactactgcagaaaccccgacggccagcccagaccctggtgctacaccctggacccccacaccagatgggagtactgcgccatcaagacctgcggcgacatcacctgggccctgaactag

SEQ ID NO: 1963 - DNA, 426 bp, Artificial Sequence
  Description of Artificial Sequence: Synthetic coding sequence
atgtgggtgaccaagctgctgcccgccctgctgctgcagcacgtgctgctgcacctgctgctgctgcccatcgccatcccctacgccgagggccagagaaagagaagaaacaccatccacgagttcaagaagagcgccaagaccaccctgatcaagatcgaccccgccctgaagatcaagaccaagaaggtgaacaccgccgaccagtgcgccaacagatgcaccagaaacaagggcctgcccttcacctgcaaggccttcgtgttcgacaaggccagaaagcagtgcctgtggttccccttcaacagcatgagcagcggcgtgaagaaggagttcggccacgagttcgacctgtacgagaacaaggactacatcagaaactgcatcatcggcaagggcagaagctacaagggcaccgtgagctag

SEQ ID NO: 1964 - DNA, 357 bp, Artificial Sequence
  Description of Artificial Sequence: Synthetic coding sequence
atgtgggtgaccaagctgctgcccgccctgctgctgcagcacgtgctgctgcacctgctgctgctgcccatcgccatcccctacgccgagggccagagaaagagaagaaacaccatccacgagttcaagaagagcgccaagaccaccctgatcaagatcgaccccgccctgaagatcaagaccaagaaggtgaacaccgccgaccagtgcgccaacagatgcaccagaaacaagggcctgcccttcacctgcaaggccttcgtgttcgacaaggccagaaagcagtgcctgtggttccccttcaacagcatgagcagcggcgtgaagaaggagttcggccacgagttcgacctgtag

SEQ ID NO: 1965 - DNA, 633 bp, Artificial Sequence
  Description of Artificial Sequence: Synthetic coding sequence
atgtgggtgaccaagctgctgcccgccctgctgctgcagcacgtgctgctgcacctgctgctgctgcccatcgccatcccctacgccgagggccagagaaagagaagaaacaccatccacgagttcaagaagagcgccaagaccaccctgatcaagatcgaccccgccctgaagatcaagaccaagaaggtgaacaccgccgaccagtgcgccaacagatgcaccagaaacaagggcctgcccttcacctgcaaggccttcgtgttcgacaaggccagaaagcagtgcctgtggttccccttcaacagcatgagcagcggcgtgaagaaggagttcggccacgagttcgacctgtacgagaacaaggactacatcagaaactgcatcatcggcaagggcagaagctacaagggcaccgtgagcatcaccaagagcggcatcaagtgccagccctggagcagcatgatcccccacgagcacagcttcctgcccagcagctacagaggcaaggacctgcaggagaactactgcagaaaccccagaggcgaggagggcggcccctggtgcttcaccagcaaccccgaggtgagatacgaggtgtgcgacatcccccagtgcagcgagggcaagtag

SEQ ID NO: 1966 - DNA, 873 bp, Artificial Sequence
  Description of Artificial Sequence: Synthetic coding sequence
atgtgggtgaccaagctgctgcccgccctgctgctgcagcacgtgctgctgcacctgctgctgctgcccatcgccatcccctacgccgagggccagagaaagagaagaaacaccatccacgagttcaagaagagcgccaagaccaccctgatcaagatcgaccccgccctgaagatcaagaccaagaaggtgaacaccgccgaccagtgcgccaacagatgcaccagaaacaagggcctgcccttcacctgcaaggccttcgtgttcgacaaggccagaaagcagtgcctgtggttccccttcaacagcatgagcagcggcgtgaagaaggagttcggccacgagttcgacctgtacgagaacaaggactacatcagaaactgcatcatcggcaagggcagaagctacaagggcaccgtgagcatcaccaagagcggcatcaagtgccagccctggagcagcatgatcccccacgagcacagcttcctgcccagcagctacagaggcaaggacctgcaggagaactactgcagaaaccccagaggcgaggagggcggcccctggtgcttcaccagcaaccccgaggtgagatacgaggtgtgcgacatcccccagtgcagcgaggtggagtgcatgacctgcaacggcgagagctacagaggcctgatggaccacaccgagagcggcaagatctgccagagatgggaccaccagaccccccacagacacaagttcctgcccgagagataccccgacaagggcttcgacgacaactactgcagaaaccccgacggccagcccagaccctggtgctacaccctggacccccacaccagatgggagtactgcgccatcaagacctgcgagacctag

SEQ ID NO: 1967 - DNA, 858 bp, Artificial Sequence
  Description of Artificial Sequence: Synthetic coding sequence
atgtgggtgaccaagctgctgcccgccctgctgctgcagcacgtgctgctgcacctgctgctgctgcccatcgccatcccctacgccgagggccagagaaagagaagaaacaccatccacgagttcaagaagagcgccaagaccaccctgatcaagatcgaccccgccctgaagatcaagaccaagaaggtgaacaccgccgaccagtgcgccaacagatgcaccagaaacaagggcctgcccttcacctgcaaggccttcgtgttcgacaaggccagaaagcagtgcctgtggttccccttcaacagcatgagcagcggcgtgaagaaggagttcggccacgagttcgacctgtacgagaacaaggactacatcagaaactgcatcatcggcaagggcagaagctacaagggcaccgtgagcatcaccaagagcggcatcaagtgccagccctggagcagcatgatcccccacgagcacagctacagaggcaaggacctgcaggagaactactgcagaaaccccagaggcgaggagggcggcccctggtgcttcaccagcaaccccgaggtgagatacgaggtgtgcgacatcccccagtgcagcgaggtggagtgcatgacctgcaacggcgagagctacagaggcctgatggaccacaccgagagcggcaagatctgccagagatgggaccaccagaccccccacagacacaagttcctgcccgagagataccccgacaagggcttcgacgacaactactgcagaaaccccgacggccagcccagaccctggtgctacaccctggacccccacaccagatgggagtactgcgccatcaagacctgcgagacctag

SEQ ID NO: 1968 - DNA, 2172 bp, Artificial Sequence
  Description of Artificial Sequence: Synthetic coding sequence
atgtgggtgaccaagctgctgcccgccctgctgctgcagcacgtgctgctgcacctgctgctgctgcccatcgccatcccctacgccgagggccagagaaagagaagaaacaccatccacgagttcaagaagagcgccaagaccaccctgatcaagatcgaccccgccctgaagatcaagaccaagaaggtgaacaccgccgaccagtgcgccaacagatgcaccagaaacaagggcctgcccttcacctgcaaggccttcgtgttcgacaaggccagaaagcagtgcctgtggttccccttcaacagcatgagcagcggcgtgaagaaggagttcggccacgagttcgacctgtacgagaacaaggactacatcagaaactgcatcatcggcaagggcagaagctacaagggcaccgtgagcatcaccaagagcggcatcaagtgccagccctggagcagcatgatcccccacgagcacagctacagaggcaaggacctgcaggagaactactgcagaaaccccagaggcgaggagggcggcccctggtgcttcaccagcaaccccgaggtgagatacgaggtgtgcgacatcccccagtgcagcgaggtggagtgcatgacctgcaacggcgagagctacagaggcctgatggaccacaccgagagcggcaagatctgccagagatgggaccaccagaccccccacagacacaagttcctgcccgagagataccccgacaagggcttcgacgacaactactgcagaaaccccgacggccagcccagaccctggtgctacaccctggacccccacaccagatgggagtactgcgccatcaagacctgcgccgacaacaccatgaacgacaccgacgtgcccctggagaccaccgagtgcatccagggccagggcgagggctacagaggcaccgtgaacaccatctggaacggcatcccctgccagagatgggacagccagtacccccacgagcacgacatgacccccgagaacttcaagtgcaaggacctgagagagaactactgcagaaaccccgacggcagcgagagcccctggtgcttcaccaccgaccccaacatcagagtgggctactgcagccagatccccaactgcgacatgagccacggccaggactgctacagaggcaacggcaagaactacatgggcaacctgagccagaccagaagcggcctgacctgcagcatgtgggacaagaacatggaggacctgcacagacacatcttctgggagcccgacgccagcaagctgaacgagaactactgcagaaaccccgacgacgacgcccacggcccctggtgctacaccggcaaccccctgatcccctgggactactgccccatcagcagatgcgagggcgacaccacccccaccatcgtgaacctggaccaccccgtgatcagctgcgccaagaccaagcagctgagagtggtgaacggcatccccaccagaaccaacatcggctggatggtgagcctgagatacagaaacaagcacatctgcggcggcagcctgatcaaggagagctgggtgctgaccgccagacagtgcttccccagcagagacctgaaggactacgaggcctggctgggcatccacgacgtgcacggcagaggcgacgagaagtgcaagcaggtgctgaacgtgagccagctggtgtacggccccgagggcagcgacctggtgctgatgaagctggccagacccgccgtgctggacgacttcgtgagcaccatcgacctgcccaactacggctgcaccatccccgagaagaccagctgcagcgtgtacggctggggctacaccggcctgatcaactacgacggcctgctgagagtggcccacctgtacatcatgggcaacgagaagtgcagccagcaccacagaggcaaggtgaccctgaacgagagcgagatctgcgccggcgccgagaagatcggcagcggcccctgcgagggcgactacggcggccccctggtgtgcgagcagcacaagatgagaatggtgctgggcgtgatcgtgcccggcagaggctgcgccatccccaacagacccggcatcttcgtgagagtggcctactacgccaagtggatccacaagatcatcctgacctacaaggtgccccagagctag

SEQ ID NO: 1969 - DNA, 363 bp, Artificial Sequence
  Description of Artificial Sequence: Synthetic coding sequence
atgaacggcgaggagaagagctgcagcggctacggcggccccgacgccatggacggcaagctggtgagcagcgacgacgacgacttcatcgtgaagagagagcacaccagagccagcggcatcagaaaggccgtgctgagcggccccggccagagcgccgagaacgagaccgaccaggtgaacttcagagagatcccccccagatgctaccccaagcacgccaaggcctgcatctacttcacctacaaggtgcactacagcaacagcagcaccgagatccccgagttcctgaccgccctggaggtgctgatggccagcgacttcctggacatctacatcttcctgttcttcctgttcttctag

SEQ ID NO: 1970 - DNA, 255 bp, Artificial Sequence
  Description of Artificial Sequence: Synthetic coding sequence
atggccctgagcagccagatctgggccgcctgcctgctgctgctgctgctgctggccagcctgaccagcggcagcgtgttcccccagcagaccggccagctggccgagctgcagccccaggacagagccggcgccagagccagctggatgcccatgttccagagaagaagaagaagagacacccacttccccatctgcatcttctgctgcggctgctgccacagaagcaagtgcggcatgtgctgcaagacctag

SEQ ID NO: 1971 - DNA, 1422 bp, Artificial Sequence
  Description of Artificial Sequence: Synthetic coding sequence
atggccgtgatggcccccagaaccctggtgctgctgctgagcggcgccctggccctgacccagacctgggccgaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggctag

SEQ ID NO: 1972 - DNA, 717 bp, Artificial Sequence
  Description of Artificial Sequence: Synthetic coding sequence
atggccgtgatggcccccagaaccctggtgctgctgctgagcggcgccctggccctgacccagacctgggccgacatccagatgacccagagccccagcagcctgagcgccagcgtgggcgacagagtgaccatcacctgcagagccagccaggacgtgaacaccgccgtggcctggtaccagcagaagcccggcaaggcccccaagctgctgatctacagcgccagcttcctgtacagcggcgtgcccagcagattcagcggcagcagaagcggcaccgacttcaccctgaccatcagcagcctgcagcccgaggacttcgccacctactactgccagcagcactacaccaccccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgctag

SEQ ID NO: 1973 - DNA, 657 bp, Artificial Sequence
  Description of Artificial Sequence: Synthetic coding sequence
atggccaccagaagccccggcgtggtgatcagcgacgacgagcccggctacgacctggacctgttctgcatccccaaccactacgccgaggacctggagagagtgttcatcccccacggcctgatcatggacagaaccgagagactggccagagacgtgatgaaggagatgggcggccaccacatcgtggccctgtgcgtgctgaagggcggctacaagttcttcgccgacctgctggactacatcaaggccctgaacagaaacagcgacagaagcatccccatgaccgtggacttcatcagactgaagagctactgcaacgaccagagcaccggcgacatcaaggtgatcggcggcgacgacctgagcaccctgaccggcaagaacgtgctgatcgtggaggacatcatcgacaccggcaagaccatgcagaccctgctgagcctggtgagacagtacaaccccaagatggtgaaggtggccagcctgctggtgaagagaacccccagaagcgtgggctacaagcccgacttcgtgggcttcgagatccccgacaagttcgtggtgggctacgccctggactacaacgagtacttcagagacctgaaccacgtgtgcgtgatcagcgagaccggcaaggccaagtacaaggcctag

SEQ ID NO: 1974 - DNA, 657 bp, Artificial Sequence
  Description of Artificial Sequence: Synthetic coding sequence
atggccaccagaagccccggcgtggtgatcagcgacgacgagcccggctacgacctggacctgttctgcatccccaaccactacgccgaggacctggagagagtgttcatcccccacggcctgatcatggacagaaccgagagactggccagagacgtgatgaaggagatgggcggccaccacatcgtggccctgtgcgtgctgaagggcggctacaagttcttcgccgacctgctggactacatcaaggccctgaacagaaacagcgacagaagcatccccatgaccgtggacttcatcagactgaagagctactgcaacgaccagagcaccggcgacatcaaggtgatcggcggcgacgacctgagcaccctgaccggcaagagcagactgctggccgaggacatcatcgacaccggcaagaccatgcagaccctgctgagcctggtgagacagtacaaccccaagatggtgaaggtggccagcctgctggtgaagagaacccccagaagcgtgggctacaagcccgacttcgtgggcttcgagatccccgacaagttcgtggtgggctacgccctggactacaacgagtacttcagagacctgaaccacgtgtgcgtgatcagcgagaccggcaaggccaagtacaaggcctag

SEQ ID NO: 1975 - DNA, 1653 bp, Artificial Sequence
  Description of Artificial Sequence: Synthetic coding sequence
atgcccccccccagaaccggcagaggcctgctgtggctgggcctggtgctgagcagcgtgtgcgtggccctgggcagcgagacccaggccaacagcaccaccgacgccctgaacgtgctgctgatcatcgtggacgacctgagacccagcctgggctgctacggcgacaagctggtgagaagccccaacatcgaccagctggccagccacagcctgctgttccagaacgccttcgcccagcaggccgtgtgcgcccccagcagagtgagcttcctgaccggcagaagacccgacaccaccagactgtacgacttcaacagctactggagagtgcacgccggcaacttcagcaccatcccccagtacttcaaggagaacggctacgtgaccatgagcgtgggcaaggtgttccaccccggcatcagcagcaaccacaccgacgacagcccctacagctggagcttccccccctaccaccccagcagcgagaagtacgagaacaccaagacctgcagaggccccgacggcgagctgcacgccaacctgctgtgccccgtggacgtgctggacgtgcccgagggcaccctgcccgacaagcagagcaccgagcaggccatccagctgctggagaagatgaagaccagcgccagccccttcttcctggccgtgggctaccacaagccccacatccccttcagataccccaaggagttccagaagctgtaccccctggagaacatcaccctggcccccgaccccgaggtgcccgacggcctgccccccgtggcctacaacccctggatggacatcagacagagagaggacgtgcaggccctgaacatcagcgtgccctacggccccatccccgtggacttccagagaaagatcagacagagctacttcgccagcgtgagctacctggacacccaggtgggcagactgctgagcgccctggacgacctgcagctggccaacagcaccatcatcgccttcaccagcgaccacggctgggccctgggcgagcacggcgagtgggccaagtacagcaacttcgacgtggccacccacgtgcccctgatcttctacgtgcccggcagaaccgccagcctgcccgaggccggcgagaagctgttcccctacctggaccccttcgacagcgccagccagctgatggagcccggcagacagagcatggacctggtggagctggtgagcctgttccccaccctggccggcctggccggcctgcaggtgccccccagatgccccgtgcccagcttccacgtggagctgtgcagagagggcaagaacctgctgaagcacttcagattcagagacctggaggaggacccctacctgcccggcaaccccagagagctgatcgcctacagccagtaccccagacccagcgacatcccccagtggaacagcgacaagcccagcctgaaggacatcaagatcatgggctacagcatcagaaccatcgactacagatacaccgtgtgggtgggcttcaaccccgacgagttcctggccaacttcagcgacatccacgccggcgagctgtacttcgtggacagcgaccccctgcaggaccacaacatgtacaacgacagccagggcggcgacctgttccagctgctgatgccctag

SEQ ID NO: 1976 - DNA, 1032 bp, Artificial Sequence
  Description of Artificial Sequence: Synthetic coding sequence
atgcccccccccagaaccggcagaggcctgctgtggctgggcctggtgctgagcagcgtgtgcgtggccctgggcagcgagacccaggccaacagcaccaccgacgccctgaacgtgctgctgatcatcgtggacgacctgagacccagcctgggctgctacggcgacaagctggtgagaagccccaacatcgaccagctggccagccacagcctgctgttccagaacgccttcgcccagcaggccgtgtgcgcccccagcagagtgagcttcctgaccggcagaagacccgacaccaccagactgtacgacttcaacagctactggagagtgcacgccggcaacttcagcaccatcccccagtacttcaaggagaacggctacgtgaccatgagcgtgggcaaggtgttccaccccggcatcagcagcaaccacaccgacgacagcccctacagctggagcttccccccctaccaccccagcagcgagaagtacgagaacaccaagacctgcagaggccccgacggcgagctgcacgccaacctgctgtgccccgtggacgtgctggacgtgcccgagggcaccctgcccgacaagcagagcaccgagcaggccatccagctgctggagaagatgaagaccagcgccagccccttcttcctggccgtgggctaccacaagccccacatccccttcagataccccaaggagttccagaagctgtaccccctggagaacatcaccctggcccccgaccccgaggtgcccgacggcctgccccccgtggcctacaacccctggatggacatcagacagagagaggacgtgcaggccctgaacatcagcgtgccctacggccccatccccgtggacttccagagaaagatcagacagagctacttcgccagcgtgagctacctggacacccaggtgggcagactgctgagcgccctggacgacctgcagctggccaacagcaccatcatcgccttcaccagcgaccacggcttcctgatgagaaccaacacctag

SEQ ID NO: 1977 - DNA, 939 bp, Artificial Sequence
  Description of Artificial Sequence: Synthetic coding sequence
atgcccccccccagaaccggcagaggcctgctgtggctgggcctggtgctgagcagcgtgtgcgtggccctgggcagcgagacccaggccaacagcaccaccgacgccctgaacgtgctgctgatcatcgtggacgacctgagacccagcctgggctgctacggcgacaagctggtgagaagccccaacatcgaccagctggccagccacagcctgctgttccagaacgccttcgcccagcaggccgtgtgcgcccccagcagagtgagcttcctgaccggcagaagacccgacaccaccagactgtacgacttcaacagctactggagagtgcacgccggcaacttcagcaccatcccccagtacttcaaggagaacggctacgtgaccatgagcgtgggcaaggtgttccaccccggcatcagcagcaaccacaccgacgacagcccctacagctggagcttccccccctaccaccccagcagcgagaagtacgagaacaccaagacctgcagaggccccgacggcgagctgcacgccaacctgctgtgccccgtggacgtgctggacgtgcccgagggcaccctgcccgacaagcagagcaccgagcaggccatccagctgctggagaagatgaagaccagcgccagccccttcttcctggccgtgggctaccacaagccccacatccccttcagataccccaaggagttccagaagctgtaccccctggagaacatcaccctggcccccgaccccgaggtgcccgacggcctgccccccgtggcctacaacccctggatggacatcagacagagagaggacgtgcaggccctgaacatcagcgtgccctacggccccatccccgtggacttccaggaggaccagagcagcaccggcttcagactgaagaccagcagcaccagaaagtacaagtag

SEQ ID NO: 1978 - DNA, 540 bp, Artificial Sequence
  Description of Artificial Sequence: Synthetic coding sequence
atgcccccccccagaaccggcagaggcctgctgtggctgggcctggtgctgagcagcgtgtgcgtggccctgggcagcgagacccaggccaacagcaccaccgacgccctgaacgtgctgctgatcatcgtggacgacctgagacccagcctgggctgctacggcgacaagctggtgagaagccccaacatcgaccagctggccagccacagcctgctgttccagaacgccttcgcccagcaggccgtgtgcgcccccagcagagtgagcttcctgaccggcagaagacccgacaccaccagactgtacgacttcaacagctactggagagtgcacgccggcaacttcagcaccatcccccagtacttcaaggagaacggctacgtgaccatgagcgtgggcaaggtgttccaccccggcaccgccccctgccccgagagcggcttcagctggttcgtggtgagcgagagcagcatccccatcctgggcatgggcctgagcctgcagagccccctgctggccggcagagtgcccagatag

SEQ ID NO: 1979 - DNA, 261 bp, Artificial Sequence
  Description of Artificial Sequence: Synthetic coding sequence
atgcccccccccagaaccggcagaggcctgctgtggctgggcctggtgctgagcagcgtgtgcgtggccctgggcagcgagacccaggccaacagcaccaccgacgccctgaacgtgctgctgatcatcgtggacgacctgagacccagcctgggctgctacggcgacaagctggtgagaagccccaacatcgaccagctggccagccacagcctgctgttccagaacgccttcgcccagcaggccgtgtgcgccccctag

SEQ ID NO: 1980 - DNA, 462 bp, Artificial Sequence
  Description of Artificial Sequence: Synthetic coding sequence
atggacctggtggagctggtgagcctgttccccaccctggccggcctggccggcctgcaggtgccccccagatgccccgtgcccagcttccacgtggagctgtgcagagagggcaagaacctgctgaagcacttcagattcagagacctggaggaggacccctacctgcccggcaaccccagagagctgatcgcctacagccagtaccccagacccagcgacatcccccagtggaacagcgacaagcccagcctgaaggacatcaagatcatgggctacagcatcagaaccatcgactacagatacaccgtgtgggtgggcttcaaccccgacgagttcctggccaacttcagcgacatccacgccggcgagctgtacttcgtggacagcgaccccctgcaggaccacaacatgtacaacgacagccagggcggcgacctgttccagctgctgatgccctag

SEQ ID NO: 1981 - DNA, 1020 bp, Artificial Sequence
  Description of Artificial Sequence: Synthetic coding sequence
atgaagaccagcgccagccccttcttcctggccgtgggctaccacaagccccacatccccttcagataccccaaggagttccagaagctgtaccccctggagaacatcaccctggcccccgaccccgaggtgcccgacggcctgccccccgtggcctacaacccctggatggacatcagacagagagaggacgtgcaggccctgaacatcagcgtgccctacggccccatccccgtggacttccagagaaagatcagacagagctacttcgccagcgtgagctacctggacacccaggtgggcagactgctgagcgccctggacgacctgcagctggccaacagcaccatcatcgccttcaccagcgaccacggctgggccctgggcgagcacggcgagtgggccaagtacagcaacttcgacgtggccacccacgtgcccctgatcttctacgtgcccggcagaaccgccagcctgcccgaggccggcgagaagctgttcccctacctggaccccttcgacagcgccagccagctgatggagcccggcagacagagcatggacctggtggagctggtgagcctgttccccaccctggccggcctggccggcctgcaggtgccccccagatgccccgtgcccagcttccacgtggagctgtgcagagagggcaagaacctgctgaagcacttcagattcagagacctggaggaggacccctacctgcccggcaaccccagagagctgatcgcctacagccagtaccccagacccagcgacatcccccagtggaacagcgacaagcccagcctgaaggacatcaagatcatgggctacagcatcagaaccatcgactacagatacaccgtgtgggtgggcttcaaccccgacgagttcctggccaacttcagcgacatccacgccggcgagctgtacttcgtggacagcgaccccctgcaggaccacaacatgtacaacgacagccagggcggcgacctgttccagctgctgatgccctag

SEQ ID NO: 1982 - DNA, 1962 bp, Artificial Sequence
  Description of Artificial Sequence: Synthetic coding sequence
atgagacccctgagacccagagccgccctgctggccctgctggccagcctgctggccgccccccccgtggcccccgccgaggccccccacctggtgcacgtggacgccgccagagccctgtggcccctgagaagattctggagaagcaccggcttctgcccccccctgccccacagccaggccgaccagtacgtgctgagctgggaccagcagctgaacctggcctacgtgggcgccgtgccccacagaggcatcaagcaggtgagaacccactggctgctggagctggtgaccaccagaggcagcaccggcagaggcctgagctacaacttcacccacctggacggctacctggacctgctgagagagaaccagctgctgcccggcttcgagctgatgggcagcgccagcggccacttcaccgacttcgaggacaagcagcaggtgttcgagtggaaggacctggtgagcagcctggccagaagatacatcggcagatacggcctggcccacgtgagcaagtggaacttcgagacctggaacgagcccgaccaccacgacttcgacaacgtgagcatgaccatgcagggcttcctgaactactacgacgcctgcagcgagggcctgagagccgccagccccgccctgagactgggcggccccggcgacagcttccacaccccccccagaagccccctgagctggggcctgctgagacactgccacgacggcaccaacttcttcaccggcgaggccggcgtgagactggactacatcagcctgcacagaaagggcgccagaagcagcatcagcatcctggagcaggagaaggtggtggcccagcagatcagacagctgttccccaagttcgccgacacccccatctacaacgacgaggccgaccccctggtgggctggagcctgccccagccctggagagccgacgtgacctacgccgccatggtggtgaaggtgatcgcccagcaccagaacctgctgctggccaacaccaccagcgccttcccctacgccctgctgagcaacgacaacgccttcctgagctaccacccccaccccttcgcccagagaaccctgaccgccagattccaggtgaacaacaccagacccccccacgtgcagctgctgagaaagcccgtgctgaccgccatgggcctgctggccctgctggacgaggagcagctgtgggccgaggtgagccaggccggcaccgtgctggacagcaaccacaccgtgggcgtgctggccagcgcccacagaccccagggccccgccgacgcctggagagccgccgtgctgatctacgccagcgacgacaccagagcccaccccaacagaagcgtggccgtgaccctgagactgagaggcgtgccccccggccccggcctggtgtacgtgaccagatacctggacaacggcctgtgcagccccgacggcgagtggagaagactgggcagacccgtgttccccaccgccgagcagttcagaagaatgagagccgccgaggaccccgtggccgccgcccccagacccctgcccgccggcggcagactgaccctgagacccgccctgagactgcccagcctgctgctggtgcacgtgtgcgccagacccgagaagccccccggccaggtgaccagactgagagccctgcccctgacccagggccagctggtgctggtgtggagcgacgagcacgtgggcagcaagtgcctgtggacctacgagatccagttcagccaggacggcaaggcctacacccccgtgagcagaaagcccagcaccttcaacctgttcgtgttcagccccgacaccggcgccgtgagcggcagctacagagtgagagccctggactactgggccagacccggccccttcagcgaccccgtgccctacctggaggtgcccgtgcccagaggcccccccagccccggcaacccctag

SEQ ID NO: 1983 - DNA, 2028 bp, Artificial Sequence
  Description of Artificial Sequence: Synthetic coding sequence
atgagacccctgagacccagagccgccctgctggccctgctggccagcctgctggccgccccccccgtggcccccgccgaggccccccacctggtgcacgtggacgccgccagagccctgtggcccctgagaagattctggagaagcaccggcttctggggcagcaccggcagaggcctgagctacaacttcacccacctggacggctacctggacctgctgagagagaaccagctgctgcccggcttcgagctgatgggcagcgccagcggccacttcaccgacttcgaggacaagcagcaggtgttcgagtggaaggacctggtgagcagcctggccagaagatacatcggcagatacggcctggcccacgtgagcaagtggaacttcgagacctggaacgagcccgaccaccacgacttcgacaacgtgagcatgaccatgcagggcttcctgaactactacgacgcctgcagcgagggcctgagagccgccagccccgccctgagactgggcggccccggcgacagcttccacaccccccccagaagccccctgagctggggcctgctgagacactgccacgacggcaccaacttcttcaccggcgaggccggcgtgagactggactacatcagcctgcacagaaaggtgagacccgccccccccagcgcccccgtgttctgcgccctgagcagatgcgcccccggcagagccgaccccggcggcgccgaggccgccccccccgccggctgcgcccagctgcacctgcaccccggcgccggcgagggcagaagagccgccgaccccgccgccctgccccaggtgagaggccacccccacctgcagagaagaggcggccccgccggcggcctggtgcccgccaccgccgtggagggcggcagagacctgagaggccacggcggcgagggcggccccgcccagagacccgccagaccccccgccaccttcctgcccagaagagacagaagagccgtggccgccccccccggccccagctgccccggccacccccaggtgatcgcccagcaccagaacctgctgctggccaacaccaccagcgccttcccctacgccctgctgagcaacgacaacgccttcctgagctaccacccccaccccttcgcccagagaaccctgaccgccagattccaggtgaacaacaccagacccccccacgtgcagctgctgagaaagcccgtgctgaccgccatgggcctgctggccctgctggacgaggagcagctgtgggccgaggtgagccaggccggcaccgtgctggacagcaaccacaccgtgggcgtgctggccagcgcccacagaccccagggccccgccgacgcctggagagccgccgtgctgatctacgccagcgacgacaccagagcccaccccaacagaagcgtggccgtgaccctgagactgagaggcgtgccccccggccccggcctggtgtacgtgaccagatacctggacaacggcctgtgcagccccgacggcgagtggagaagactgggcagacccgtgttccccaccgccgagcagttcagaagaatgagagccgccgaggaccccgtggccgccgcccccagacccctgcccgccggcggcagactgaccctgagacccgccctgagactgcccagcctgctgctggtgcacgtgtgcgccagacccgagaagccccccggccaggtgaccagactgagagccctgcccctgacccagggccagctggtgctggtgtggagcgacgagcacgtgggcagcaagtgcctgtggacctacgagatccagttcagccaggacggcaaggcctacacccccgtgagcagaaagcccagcaccttcaacctgttcgtgttcagccccgacaccggcgccgtgagcggcagctacagagtgagagccctggactactgggccagacccggccccttcagcgaccccgtgccctacctggaggtgcccgtgcccagaggcccccccagccccggcaacccctag

SEQ ID NO: 1984 - DNA, 603 bp, Artificial Sequence
  Description of Artificial Sequence: Synthetic coding sequence
atggccctgtggatgagactgctgcccctgctggccctgctggccctgtggggccccgaccccgccgccgccttcgtgaaccagcacctgtgcggcagccacctggtggaggccctgtacctggtgtgcggcgagagaggcttcttctacacccccaagaccagaagagaggccgaggacctgcaggccagcgccctgagcctgagcagcagcaccagcacctggcccgagggcctggacgccaccgccagagccccccccgccctggtggtgaccgccaacatcggccaggccggcggcagcagcagcagacagttcagacagagagccctgggcaccagcgacagccccgtgctgttcatccactgccccggcgccgccggcaccgcccagggcctggagtacagaggcagaagagtgaccaccgagctggtgtgggaggaggtggacagcagcccccagccccagggcagcgagagcctgcccgcccagccccccgcccagcccgccccccagcccgagccccagcaggccagagagcccagccccgaggtgagctgctgcggcctgtggcccagaagaccccagagaagccagaactag

SEQ ID NO: 1985 - DNA, 333 bp, Artificial Sequence
  Description of Artificial Sequence: Synthetic coding sequence
atggccctgtggatgagactgctgcccctgctggccctgctggccctgtggggccccgaccccgccgccgccttcgtgaaccagcacctgtgcggcagccacctggtggaggccctgtacctggtgtgcggcgagagaggcttcttctacacccccaagaccagaagagaggccgaggacctgcaggtgggccaggtggagctgggcggcggccccggcgccggcagcctgcagcccctggccctggagggcagcctgcagaagagaggcatcgtggagcagtgctgcaccagcatctgcagcctgtaccagctggagaactactgcaactag

SEQ ID NO: 1986 - DNA, 333 bp, Artificial Sequence; identical to SEQ ID NO: 1985
  Description of Artificial Sequence: Synthetic coding sequence

SEQ ID NO: 1987 - DNA, 333 bp, Artificial Sequence; identical to SEQ ID NO: 1985
  Description of Artificial Sequence: Synthetic coding sequence

SEQ ID NO: 1988 - DNA, 297 bp, Artificial Sequence
  Description of Artificial Sequence: Synthetic coding sequence
atggccctgtggatgagactgctgcccctgctggccctgctggccctgtggggccccgaccccgccgccgccttcgtgaaccagcacctgtgcggcagccacctggtggaggccctgtacctggtgtgcggcgagagaggcttcttctacacccccaagaccagaagagaggccgaggacctgcagggcagcctgcagcccctggccctggagggcagcctgcagaagagaggcatcgtggagcagtgctgcaccagcatctgcagcctgtaccagctggagaactactgcaactag

SEQ ID NO: 1989 - DNA, 333 bp, Artificial Sequence
  Description of Artificial Sequence: Synthetic coding sequence
atggccctgtggatgagactgctgcccctgctggccctgctggccctgtggggccccgaccccgccgccgccttcgtgaaccagcacctgtgcggcagccacctggtggaggccctgtacctggtgtgcggcgagagaggcttcttctacaccgacaagaccagaagagaggccgaggacctgcaggtgggccaggtggagctgggcggcggccccggcgccggcagcctgcagcccctggccctggagggcagcctgcagaagagaggcatcgtggagcagtgctgcaccagcatctgcagcctgtaccagctggagaactactgcaactag

SEQ ID NO: 1990 - DNA, 333 bp, Artificial Sequence
  Description of Artificial Sequence: Synthetic coding sequence
atggccctgtggatgagactgctgcccctgctggccctgctggccctgtggggccccgaccccgccgccgccttcgtgaaccagcacctgtgcggcagccacctggtggaggccctgtacctggtgtgcggcgagagaggcttcttctacacccccaagaccagaagagaggccgaggacctgcaggtgggccaggtggagctgggcggcggccccggcgccggcagcctgcagcccctggccctggagggcagcctgcagaagagaggcatcgtggagcagtgctgcaccagcatctgcagcctgtaccagctggagaactactgcggctag

SEQ ID NO: 1991 - DNA, 333 bp, Artificial Sequence
  Description of Artificial Sequence: Synthetic coding sequence
atggccctgtggatgagactgctgcccctgctggccctgctggccctgtggggccccgaccccgccgccgccttcgtgaagcagcacctgtgcggcagccacctggtggaggccctgtacctggtgtgcggcgagagaggcttcttctacacccccgagaccagaagagaggccgaggacctgcaggtgggccaggtggagctgggcggcggccccggcgccggcagcctgcagcccctggccctggagggcagcctgcagaagagaggcatcgtggagcagtgctgcaccagcatctgcagcctgtaccagctggagaactactgcaactag

SEQ ID NO: 1992 - DNA, 333 bp, Artificial Sequence
  Description of Artificial Sequence: Synthetic coding sequence
atggccctgtggatgagactgctgcccctgctggccctgctggccctgtggggccccgaccccgccgccgccttcgtgaaccagcacctgtgcggcagccacctggtggaggccctgtacctggtgtgcggcgagagaggcttcttctacaccaagcccaccagaagagaggccgaggacctgcaggtgggccaggtggagctgggcggcggccccggcgccggcagcctgcagcccctggccctggagggcagcctgcagaagagaggcatcgtggagcagtgctgcaccagcatctgcagcctgtaccagctggagaactactgcaactag

SEQ ID NO: 1993 - DNA, 570 bp, Artificial Sequence
  Description of Artificial Sequence: Synthetic coding sequence
atggccctgagcttcagcctgctgatggccgtgctggtgctgagctacaagagcatctgcagcctgggctgcgacctgccccagacccacagcctgggcaacagaagagccctgatcctgctgggccagatgggcagaatcagccccttcagctgcctgaaggacagacacgacttcagaatcccccaggaggagttcgacggcaaccagttccagaaggcccaggccatcagcgtgctgcacgagatgatccagcagaccttcaacctgttcagcaccgaggacagcagcgccgcctgggagcagagcctgctggagaagttcagcaccgagctgtaccagcagctgaacgacctggaggcctgcgtgatccaggaggtgggcgtggaggagacccccctgatgaacgaggacagcatcctggccgtgagaaagtacttccagagaatcaccctgtacctgatcgagagaaagtacagcccctgcgcctgggaggtggtgagagccgagatcatgagaagcctgagcttcagcaccaacctgcagaagagactgagaagaaaggactag

SEQ ID NO: 1994 - DNA, 573 bp, Artificial Sequence
  Description of Artificial Sequence: Synthetic coding sequence
atgatggccagccccttcgccctgctgatggccctggtggtgctgagctgcaagagcagctgcagcctgggctgcgacctgcccgagacccacagcctggacaacagaagaaccctgatgctgctggcccagatgagcagaatcagccccagcagctgcctgatggacagacacgacttcggcttcccccaggaggagttcgacggcaaccagttccagaaggcccccgccatcagcgtgctgcacgagctgatccagcagatcttcaacctgttcaccaccaaggacagcagcgccgcctgggacgaggacctgctggacaagttctgcaccgagctgtaccagcagctgaacgacctggaggcctgcgtgatgcaggaggagagagtgggcgagacccccctgatgaacgccgacagcatcctggccgtgaagaagtacttcagaagaatcaccctgtacctgaccgagaagaagtacagcccctgcgcctgggaggtggtgagagccgagatcatgagaagcctgagcctgagcaccaacctgcaggagagactgagaagaaaggagtag

SEQ ID NO: 1995 - DNA, 570 bp, Artificial Sequence
  Description of Artificial Sequence: Synthetic coding sequence
atggccctgcccttcgccctgatgatggccctggtggtgctgagctgcaagagcagctgcagcctgggctgcaacctgagccagacccacagcctgaacaacagaagaaccctgatgctgatggcccagatgagaagaatcagccccttcagctgcctgaaggacagacacgacttcgagttcccccaggaggagttcgacggcaaccagttccagaaggcccaggccatcagcgtgctgcacgagatgatgcagcagaccttcaacctgttcagcaccaagaacagcagcgccgcctgggacgagaccctgctggagaagttctacatcgagctgttccagcagatgaacgacctggaggcctgcgtgatccaggaggtgggcgtggaggagacccccctgatgaacgaggacagcatcctggccgtgaagaagtacttccagagaatcaccctgtacctgatggagaagaagtacagcccctgcgcctgggaggtggtgagagccgagatcatgagaagcctgagcttcagcaccaacctgcagaagagactgagaagaaaggactag

SEQ ID NO: 1996 - DNA, 570 bp, Artificial Sequence
  Description of Artificial Sequence: Synthetic coding sequence
atggccctgagcttcagcctgctgatggccgtgctggtgctgagctacaagagcatctgcagcctgggctgcgacctgccccagacccacagcctgggcaacagaagagccctgatcctgctggcccagatgggcagaatcagccacttcagctgcctgaaggacagatacgacttcggcttcccccaggaggtgttcgacggcaaccagttccagaaggcccaggccatcagcgccttccacgagatgatccagcagaccttcaacctgttcagcaccaaggacagcagcgccgcctgggacgagaccctgctggacaagttctacatcgagctgttccagcagctgaacgacctggaggcctgcgtgacccaggaggtgggcgtggaggagatcgccctgatgaacgaggacagcatcctggccgtgagaaagtacttccagagaatcaccctgtacctgatgggcaagaagtacagcccctgcgcctgggaggtggtgagagccgagatcatgagaagcttcagcttcagcaccaacctgcagaagggcctgagaagaaaggactag

SEQ ID NO: 1997 - DNA, 570 bp, Artificial Sequence
  Description of Artificial Sequence: Synthetic coding sequence
atggccctgagcttcagcctgctgatggccgtgctggtgctgagctacaagagcatctgcagcctgggctgcgacctgccccagacccacagcctgggcaacagaagagccctgatcctgctggcccagatgggcagaatcagccccttcagctgcctgaaggacagacacgacttcggcctgccccaggaggagttcgacggcaaccagttccagaagacccaggccatcagcgtgctgcacgagatgatccagcagaccttcaacctgttcagcaccgaggacagcagcgccgcctgggagcagagcctgctggagaagttcagcaccgagctgtaccagcagctgaacaacctggaggcctgcgtgatccaggaggtgggcatggaggagacccccctgatgaacgaggacagcatcctggccgtgagaaagtacttccagagaatcaccctgtacctgaccgagaagaagtacagcccctgcgcctgggaggtggtgagagccgagatcatgagaagcctgagcttcagcaccaacctgcagaagatcctgagaagaaaggactag

SEQ ID NO: 1998 - DNA, 567 bp, Artificial Sequence
  Description of Artificial Sequence: Synthetic coding sequence
atggccctgaccttcgccctgctggtggccctgctggtgctgagctgcaagagcagctgcagcgtgggctgcgacctgccccagacccacagcctgggcagcagaagaaccctgatgctgctggcccagatgagaagaatcagcctgttcagctgcctgaaggacagacacgacttcggcttcccccaggaggagttcggcaaccagttccagaaggccgagaccatccccgtgctgcacgagatgatccagcagatcttcaacctgttcagcaccaaggacagcagcgccgcctgggacgagaccctgctggacaagttctacaccgagctgtaccagcagctgaacgacctggaggcctgcgtgatccagggcgtgggcgtgaccgagacccccctgatgaaggaggacagcatcctggccgtgagaaagtacttccagagaatcaccctgtacctgaaggagaagaagtacagcccctgcgcctgggaggtggtgagagccgagatcatgagaagcttcagcctgagcaccaacctgcaggagagcctgagaagcaaggagtag

SEQ ID NO: 1999 - DNA, 570 bp, Artificial Sequence
  Description of Artificial Sequence: Synthetic coding sequence
atggccctgagcttcagcctgctgatggccgtgctggtgctgagctacaagagcatctgcagcctgggctgcgacctgccccagacccacagcctgggcaacagaagagccctgatcctgctggcccagatgggcagaatcagccccttcagctgcctgaaggacagacacgacttcggcttcccccaggaggagttcgacggcaaccagttccagaaggcccaggccatcagcgtgctgcacgagatgatccagcagaccttcaacctgttcagcaccaaggacagcagcgccacctgggagcagagcctgctggagaagttcagcaccgagctgaaccagcagctgaacgacctggaggcctgcgtgatccaggaggtgggcgtggaggagacccccctgatgaacgtggacagcatcctggccgtgaagaagtacttccagagaatcaccctgtacctgaccgagaagaagtacagcccctgcgcctgggaggtggtgagagccgagatcatgagaagcttcagcctgagcaagatcttccaggagagactgagaagaaaggagtag

SEQ ID NO: 2000 - DNA, 570 bp, Artificial Sequence
  Description of Artificial Sequence: Synthetic coding sequence
atggccctgagcttcagcctgctgatggccgtgctggtgctgagctacaagagcatctgcagcctgggctgcgacctgccccagacccacagcctgggcaacagaagagccctgatcctgctggcccagatgggcagaatcagccacttcagctgcctgaaggacagacacgacttcggcttccccgaggaggagttcgacggccaccagttccagaaggcccaggccatcagcgtgctgcacgagatgatccagcagaccttcaacctgttcagcaccgaggacagcagcgccgcctgggagcagagcctgctggagaagttcagcaccgagctgtaccagcagctgaacgacctggaggcctgcgtgatccaggaggtgggcgtggaggagacccccctgatgaacgaggacagcatcctggccgtgagaaagtacttccagagaatcaccctgtacctgaccgagaagaagtacagcccctgcgcctgggaggtggtgagagccgagatcatgagaagcctgagcttcagcaccaacctgcagaagagactgagaagaaaggactag

SEQ ID NO: 2001 - DNA, 570 bp, Artificial Sequence
  Description of Artificial Sequence: Synthetic coding sequence
atggccctgcccttcgtgctgctgatggccctggtggtgctgaactgcaagagcatctgcagcctgggctgcgacctgccccagacccacagcctgagcaacagaagaaccctgatgatcatggcccagatgggcagaatcagccccttcagctgcctgaaggacagacacgacttcggcttcccccaggaggagttcgacggcaaccagttccagaaggcccaggccatcagcgtgctgcacgagatgatccagcagaccttcaacctgttcagcaccaaggacagcagcgccacctgggacgagaccctgctggacaagttctacaccgagctgtaccagcagctgaacgacctggaggcctgcatgatgcaggaggtgggcgtggaggacacccccctgatgaacgtggacagcatcctgaccgtgagaaagtacttccagagaatcaccctgtacctgaccgagaagaagtacagcccctgcgcctgggaggtggtgagagccgagatcatgagaagcttcagcctgagcgccaacctgcaggagagactgagaagaaaggagtag

SEQ ID NO: 2002 - DNA, 570 bp, Artificial Sequence
  Description of Artificial Sequence: Synthetic coding sequence
atggccctgcccttcgccctgctgatggccctggtggtgctgagctgcaagagcagctgcagcctggactgcgacctgccccagacccacagcctgggccacagaagaaccatgatgctgctggcccagatgagaagaatcagcctgttcagctgcctgaaggacagacacgacttcagattcccccaggaggagttcgacggcaaccagttccagaaggccgaggccatcagcgtgctgcacgaggtgatccagcagaccttcaacctgttcagcaccaaggacagcagcgtggcctgggacgagagactgctggacaagctgtacaccgagctgtaccagcagctgaacgacctggaggcctgcgtgatgcaggaggtgtgggtgggcggcacccccctgatgaacgaggacagcatcctggccgtgagaaagtacttccagagaatcaccctgtacctgaccgagaagaagtacagcccctgcgcctgggaggtggtgagagccgagatcatgagaagcttcagcagcagcagaaacctgcaggagagactgagaagaaaggagtag

SEQ ID NO: 2003 - DNA, 570 bp, Artificial Sequence
  Description of Artificial Sequence: Synthetic coding sequence
atggccagaagcttcagcctgctgatggtggtgctggtgctgagctacaagagcatctgcagcctgggctgcgacctgccccagacccacagcctgagaaacagaagagccctgatcctgctggcccagatgggcagaatcagccccttcagctgcctgaaggacagacacgagttcagattccccgaggaggagttcgacggccaccagttccagaagacccaggccatcagcgtgctgcacgagatgatccagcagaccttcaacctgttcagcaccgaggacagcagcgccgcctgggagcagagcctgctggagaagttcagcaccgagctgtaccagcagctgaacgacctggaggcctgcgtgatccaggaggtgggcgtggaggagacccccctgatgaacgaggacttcatcctggccgtgagaaagtacttccagagaatcaccctgtacctgatggagaagaagtacagcccctgcgcctgggaggtggtgagagccgagatcatgagaagcttcagcttcagcaccaacctgaagaagggcctgagaagaaaggactag

SEQ ID NO: 2004 - DNA, 570 bp, Artificial Sequence
  Description of Artificial Sequence: Synthetic coding sequence
atggccctgaccttctacctgctggtggccctggtggtgctgagctacaagagcttcagcagcctgggctgcgacctgccccagacccacagcctgggcaacagaagagccctgatcctgctggcccagatgagaagaatcagccccttcagctgcctgaaggacagacacgacttcgagttcccccaggaggagttcgacgacaagcagttccagaaggcccaggccatcagcgtgctgcacgagatgatccagcagaccttcaacctgttcagcaccaaggacagcagcgccgccctggacgagaccctgctggacgagttctacatcgagctggaccagcagctgaacgacctggagagctgcgtgatgcaggaggtgggcgtgatcgagagccccctgatgtacgaggacagcatcctggccgtgagaaagtacttccagagaatcaccctgtacctgaccgagaagaagtacagcagctgcgcctgggaggtggtgagagccgagatcatgagaagcttcagcctgagcatcaacctgcagaagagactgaagagcaaggagtag

SEQ ID NO: 2005 - DNA, 564 bp, Artificial Sequence
  Description of Artificial Sequence: Synthetic coding sequence
atgaccaacaagtgcctgctgcagatcgccctgctgctgtgcttcagcaccaccgccctgagcatgagctacaacctgctgggcttcctgcagagaagcagcaacttccagtgccagaagctgctgtggcagctgaacggcagactggagtactgcctgaaggacagaatgaacttcgacatccccgaggagatcaagcagctgcagcagttccagaaggaggacgccgccctgaccatctacgagatgctgcagaacatcttcgccatcttcagacaggacagcagcagcaccggctggaacgagaccatcgtggagaacctgctggccaacgtgtaccaccagatcaaccacctgaagaccgtgctggaggagaagctggagaaggaggacttcaccagaggcaagctgatgagcagcctgcacctgaagagatactacggcagaatcctgcactacctgaaggccaaggagtacagccactgcgcctggaccatcgtgagagtggagatcctgagaaacttctacttcatcaacagactgaccggctacctgagaaactag

SEQ ID NO: 2006 - DNA, 537 bp, Artificial Sequence
  Description of Artificial Sequence: Synthetic coding sequence
atgcacagcagcgccctgctgtgctgcctggtgctgctgaccggcgtgagagccagccccggccagggcacccagagcgagaacagctgcacccacttccccggcaacctgcccaacatgctgagagacctgagagacgccttcagcagagtgaagaccttcttccagatgaaggaccagctggacaacctgctgctgaaggagagcctgctggaggacttcaagggctacctgggctgccaggccctgagcgagatgatccagttctacctggaggaggtgatgccccaggccgagaaccaggaccccgacatcaaggcccacgtgaacagcctgggcgagaacctgaagaccctgagactgagactgagaagatgccacagattcctgccctgcgagaacaagagcaaggccgtggagcaggtgaagaacgccttcaacaagctgcaggagaagggcatctacaaggccatgagcgagttcgacatcttcatcaactacatcgaggcctacatgaccatgaagatcagaaactag

SEQ ID NO: 2007 - DNA, 489 bp, Artificial Sequence
  Description of Artificial Sequence: Synthetic coding sequence
atgagaagcagccccggcaacatggagagaatcgtgatctgcctgatggtgatcttcctgggcaccctggtgcacaagagcagcagccagggccaggacagacacatgatcagaatgagacagctgatcgacatcgtggaccagctgaagaactacgtgaacgacctggtgcccgagttcctgcccgcccccgaggacgtggagaccaactgcgagtggagcgccttcagctgcttccagaaggcccagctgaagagcgccaacaccggcaacaacgagagaatcatcaacgtgagcatcaagaagctgaagagaaagccccccagcaccaacgccggcagaagacagaagcacagactgacctgccccagctgcgacagctacgagaagaagccccccaaggagttcctggagagattcaagagcctgctgcagaagatgatccaccagcacctgagcagcagaacccacggcagcgaggacagctag

SEQ ID NO: 2008 - DNA, 534 bp, Artificial Sequence
  Description of Artificial Sequence: Synthetic coding sequence
atgttccacgtgagcttcagatacatcttcggcctgccccccctgatcctggtgctgctgcccgtggccagcagcgactgcgacatcgagggcaaggacggcaagcagtacgagagcgtgctgatggtgagcatcgaccagctgctggacagcatgaaggagatcggcagcaactgcctgaacaacgagttcaacttcttcaagagacacatctgcgacgccaacaaggagggcatgttcctgttcagagccgccagaaagctgagacagttcctgaagatgaacagcaccggcgacttcgacctgcacctgctgaaggtgagcgagggcaccaccatcctgctgaactgcaccggccaggtgaagggcagaaagcccgccgccctgggcgaggcccagcccaccaagagcctggaggagaacaagagcctgaaggagcagaagaagctgaacgacctgtgcttcctgaagagactgctgcaggagatcaagacctgctggaacaagatcctgatgggcaccaaggagcactag

SEQ ID NO: 2009 - DNA, 216 bp, Artificial Sequence
  Description of Artificial Sequence: Synthetic coding sequence
atgttccacgtgagcttcagatacatcttcggcctgccccccctgatcctggtgctgctgcccgtggccagcagcgactgcgacatcgagggcaaggacggcaagcagtacgagagcgtgctgatggtgagcatcgaccagctgctgaaccagccctacaagaagaaggagaagagaaccgagagaaagcagcagagcgccatgagcaacaactag

SEQ ID NO: 2010 - DNA, 393 bp, Artificial Sequence
  Description of Artificial Sequence: Synthetic coding sequence
gtgagcttcagatacatcttcggcctgccccccctgatcctggtgctgctgcccgtggccagcagcgactgcgacatcgagggcaaggacggcaagcagtacgagagcgtgctgatggtgagcatcgaccagctgctggacagcatgaaggagatcggcagcaactgcctgaacaacgagttcaacttcttcaagagacacatctgcgacgccaacaaggtgaagggcagaaagcccgccgccctgggcgaggcccagcccaccaagagcctggaggagaacaagagcctgaaggagcagaagaagctgaacgacctgtgcttcctgaagagactgctgcaggagatcaagacctgctggaacaagatcctgatgggcaccaaggagcactag

SEQ ID NO: 2011 - DNA, 216 bp, Artificial Sequence; identical to SEQ ID NO: 2009
  Description of Artificial Sequence: Synthetic coding sequence

SEQ ID NO: 2012 - DNA, 114 bp, Artificial Sequence
  Description of Artificial Sequence: Synthetic coding sequence
atgttccacgtgagcttcagatacatcttcggcctgccccccctgatcctggtgctgctgcccgtggccagcagcgactgcgacatcgagggccagcacgagagaaactggtag

SEQ ID NO: 2013 - DNA, 402 bp, Artificial Sequence
  Description of Artificial Sequence: Synthetic coding sequence
atgttccacgtgagcttcagatacatcttcggcctgccccccctgatcctggtgctgctgcccgtggccagcagcgactgcgacatcgagggcaaggacggcaagcagtacgagagcgtgctgatggtgagcatcgaccagctgctggacagcatgaaggagatcggcagcaactgcctgaacaacgagttcaacttcttcaagagacacatctgcgacgccaacaaggtgaagggcagaaagcccgccgccctgggcgaggcccagcccaccaagagcctggaggagaacaagagcctgaaggagcagaagaagctgaacgacctgtgcttcctgaagagactgctgcaggagatcaagacctgctggaacaagatcctgatgggcaccaaggagcactag

SEQ ID NO: 2014 - DNA, 114 bp, Artificial Sequence; identical to SEQ ID NO: 2012
  Description of Artificial Sequence: Synthetic coding sequence

SEQ ID NO: 2015 - DNA, 195 bp, Artificial Sequence
  Description of Artificial Sequence: Synthetic coding sequence
atgaaggagatcggcagcaactgcctgaacaacgagttcaacttcttcaagagacacatctgcgacgccaacaaggaggagaacaagagcctgaaggagcagaagaagctgaacgacctgtgcttcctgaagagactgctgcaggagatcaagacctgctggaacaagatcctgatgggcaccaaggagcactag

SEQ ID NO: 2016 - DNA, 2643 bp, Artificial Sequence
  Description of Artificial Sequence: Synthetic coding sequence
atggccgagctgtacagagtgctggaggccggcaagatcggcatcttcgagagccccaccggcaccggcaagagcctgagcctgatctgcggcgccctgagctggctgagagacttcgagcagaagaagagagaggaggaggccagactgctggagaccggcaccggccccctgcacgacgagaaggacgagagcctgtgcctgagcagcagctgcgagggcgccgccggcacccccagacccgccggcgagcccgcctgggtgacccagttcgtgcagaagaaggaggagagagacctggtggacagactgaaggccgagcaggccagaagaaagcagagagaggagagactgcagcagctgcagcacagagtgcagctgaagtacgccgccaagagactgagacaggaggaggaggagagagagaacctgctgagactgagcagagagatgctggagaccggccccgaggccgagagactggagcagctggagagcggcgaggaggagctggtgctggccgagtacgagagcgacgaggagaagaaggtggccagcagagtggacgaggacgaggacgacctggaggaggagcacatcaccaagatctactactgcagcagaacccacagccagctggcccagttcgtgcacgaggtgaagaagagccccttcggcaaggacgtgagactggtgagcctgggcagcagacagaacctgtgcgtgaacgaggacgtgaagagcctgggcagcgtgcagctgatcaacgacagatgcgtggacatgcagagaagcagacacgagaagaagaagggcgccgaggaggagaagcccaagagaagaagacaggagaagcaggccgcctgccccttctacaaccacgagcagatgggcctgctgagagacgaggccctggccgaggtgaaggacatggagcagctgctggccctgggcaaggaggccagagcctgcccctactacggcagcagactggccatccccgccgcccagctggtggtgctgccctaccagatgctgctgcacgccgccaccagacaggccgccggcatcagactgcaggaccaggtggtgatcatcgacgaggcccacaacctgatcgacaccatcaccggcatgcacagcgtggaggtgagcggcagccagctgtgccaggcccacagccagctgctgcagtacgtggagagatacggcaagagactgaaggccaagaacctgatgtacctgaagcagatcctgtacctgctggagaagttcgtggccgtgctgggcggcaacatcaagcagaaccccaacacccagagcctgagccagaccggcaccgagctgaagaccatcaacgacttcctgttccagagccagatcgacaacatcaacctgttcaaggtgcagagatactgcgagaagagcatgatcagcagaaagctgttcggcttcaccgagagatacggcgccgtgttcagcagcagagagcagcccaagctggccggcttccagcagttcctgcagagcctgcagcccagaaccaccgaggccctggccgcccccgccgacgagagccaggccagcaccctgagacccgccagccccctgatgcacatccagggcttcctggccgccctgaccaccgccaaccaggacggcagagtgatcctgagcagacagggcagcctgagccagagcaccctgaagttcctgctgctgaaccccgccgtgcacttcgcccaggtggtgaaggagtgcagagccgtggtgatcgccggcggcaccatgcagcccgtgagcgacttcagacagcagctgctggcctgcgccggcgtggaggccgagagagtggtggagttcagctgcggccacgtgatcccccccgacaacatcctgcccctggtgatctgcagcggcatcagcaaccagcccctggagttcaccttccagaagagagagctgccccagatgatggacgaggtgggcagaatcctgtgcaacctgtgcggcgtggtgcccggcggcgtggtgtgcttcttccccagctacgagtacctgagacaggtgcacgcccactgggagaagggcggcctgctgggcagactggccgccagaaagaagatcttccaggagcccaagagcgcccaccaggtggagcaggtgctgctggcctacagcagatgcatccaggcctgcggccaggagagaggccaggtgaccggcgccctgctgctgagcgtggtgggcggcaagatgagcgagggcatcaacttcagcgacaacctgggcagatgcgtggtgatggtgggcatgcccttccccaacatcagaagcgccgagctgcaggagaagatggcctacctggaccagaccctgcccagagcccccggccaggccccccccggcaaggccctggtggagaacctgtgcatgaaggccgtgaaccagagcatcggcagagccatcagacaccagaaggacttcgccagcgtggtgctgctggaccagagatacgccagaccccccgtgctggccaagctgcccgcctggatcagagccagagtggaggtgaaggccaccttcggccccgccatcgccgccgtgcagaagttccacagagagaagagcgccagcagctag

SEQ ID NO: 2017 - DNA, 738 bp, Artificial Sequence
  Description of Artificial Sequence: Synthetic coding sequence
atgaagaagacccagacctggatcctgacctgcatctacctgcagctgctgctgttcaaccccctggtgaagaccgagggcatctgcagaaacagagtgaccaacaacgtgaaggacgtgaccaagctggtggccaacctgcccaaggactacatgatcaccctgaagtacgtgcccggcatggacgtgctgcccagccactgctggatcagcgagatggtggtgcagctgagcgacagcctgaccgacctgctggacaagttcagcaacatcagcgagggcctgagcaactacagcatcatcgacaagctggtgaacatcgtggacgacctggtggagtgcgtgaaggagaacagcagcaaggacctgaagaagagcttcaagagccccgagcccagactgttcacccccgaggagttcttcagaatcttcaacagaagcatcgacgccttcaaggacttcgtggtggccagcgagaccagcgactgcgtggtgagcagcaccctgagccccgagaagggcaaggccaagaacccccccggcgacagcagcctgcactgggccgccatggccctgcccgccctgttcagcctgatcatcggcttcgccttcggcgccctgtactggaagaagagacagcccagcctgaccagagccgtggagaacatccagatcaacgaggaggacaacgagatcagcatgctgcaggagaaggagagagagttccaggaggtgtag

SEQ ID NO: 2018 - DNA, 93 bp, Artificial Sequence
  Description of Artificial Sequence: Synthetic coding sequence
ggcatggacgtgctgggcagacccaagatccccctggagacccccgcctacaccggccagccctggcactgccagcactgcttcctgctgtag

SEQ ID NO: 2019 - DNA, 3039 bp, Artificial Sequence
  Description of Artificial Sequence: Synthetic coding sequence
atgcccgccagcgccccccccagaagacccagaccccccccccccagcctgagcctgctgctggtgctgctgggcctgggcggcagaagactgagagccgagcccggcgacggcgcccagacctgggccagattcagcagaccccccgcccccgaggccgccggcctgttccagggcaccttccccgacggcttcctgtgggccgtgggcagcgccgcctaccagaccgagggcggctggcagcagcacggcaagggcgccagcatctgggacaccttcacccaccaccccctggccccccccggcgacagcagaaacgccagcctgcccctgggcgcccccagccccctgcagcccgccaccggcgacgtggccagcgacagctacaacaacgtgttcagagacaccgaggccctgagagagctgggcgtgacccactacagattcagcatcagctgggccagagtgctgcccaacggcagcgccggcgtgcccaacagagagggcctgagatactacagaagactgctggagagactgagagagctgggcgtgcagcccgtggtgaccctgtaccactgggacctgccccagagactgcaggacgcctacggcggctgggccaacagagccctggccgaccacttcagagactacgccgagctgtgcttcagacacttcggcggccaggtgaagtactggatcaccatcgacaacccctacgtggtggcctggcacggctacgccaccggcagactggcccccggcatcagaggcagccccagactgggctacctggtggcccacaacctgctgctggcccacgccaaggtgtggcacctgtacaacaccagcttcagacccacccagggcggccaggtgagcatcgccctgagcagccactggatcaaccccagaagaatgaccgaccacagcatcaaggagtgccagaagagcctggacttcgtgctgggctggttcgccaagcccgtgttcatcgacggcgactaccccgagagcatgaagaacaacctgagcagcatcctgcccgacttcaccgagagcgagaagaagttcatcaagggcaccgccgacttcttcgccctgtgcttcggccccaccctgagcttccagctgctggacccccacatgaagttcagacagctggagagccccaacctgagacagctgctgagctggatcgacctggagttcaaccacccccagatcttcatcgtggagaacggctggttcgtgagcggcaccaccaagagagacgacgccaagtacatgtactacctgaagaagttcatcatggagaccctgaaggccatcaagctggacggcgtggacgtgatcggctacaccgcctggagcctgatggacggcttcgagtggcacagaggctacagcatcagaagaggcctgttctacgtggacttcctgagccaggacaagatgctgctgcccaagagcagcgccctgttctaccagaagctgatcgagaagaacggcttcccccccctgcccgagaaccagcccctggagggcaccttcccctgcgacttcgcctggggcgtggtggacaactacatccaggtggacaccaccctgagccagttcaccgacctgaacgtgtacctgtgggacgtgcaccacagcaagagactgatcaaggtggacggcgtggtgaccaagaagagaaagagctactgcgtggacttcgccgccatccagccccagatcgccctgctgcaggagatgcacgtgacccacttcagattcagcctggactgggccctgatcctgcccctgggcaaccagagccaggtgaaccacaccatcctgcagtactacagatgcatggccagcgagctggtgagagtgaacatcacccccgtggtggccctgtggcagcccatggcccccaaccagggcctgcccagactgctggccagacagggcgcctgggagaacccctacaccgccctggccttcgccgagtacgccagactgtgcttccaggagctgggccaccacgtgaagctgtggatcaccatgaacgagccctacaccagaaacatgacctacagcgccggccacaacctgctgaaggcccacgccctggcctggcacgtgtacaacgagaagttcagacacgcccagaacggcaagatcagcatcgccctgcaggccgactggatcgagcccgcctgccccttcagccagaaggacaaggaggtggccgagagagtgctggagttcgacatcggctggctggccgagcccatcttcggcagcggcgactacccctgggtgatgagagactggctgaaccagagaaacaacttcctgctgccctacttcaccgaggacgagaagaagctgatccagggcaccttcgacttcctggccctgagccactacaccaccatcctggtggacagcgagaaggaggaccccatcaagtacaacgactacctggaggtgcaggagatgaccgacatcacctggctgaacagccccagccaggtggccgtggtgccctggggcctgagaaaggtgctgaactggctgaagttcaagtacggcgacctgcccatgtacatcatcagcaacggcatcgacgacggcctgcacgccgaggacgaccagctgagagtgtactacatgcagaactacatcaacgaggccctgaaggcccacatcctggacggcatcaacctgtgcggctacttcgcctacagcttcaacgacagaaccgcccccagattcggcctgtacagatacgccgccgaccagttcgagcccaaggccagcatgaagcactacagaaagatcatcgacagcaacggcttccccggccccgagaccctggagagattctgccccgaggagttcaccgtgtgcaccgagtgcagcttcttccacaccagaaagagcctgctggccttcatcgccttcctgttcttcgccagcatcatcagcctgagcctgatcttctactacagcaagaagggcagaagaagctacaagtag

SEQ ID NO: 2020 - DNA, 729 bp, Artificial Sequence
  Description of Artificial Sequence: Synthetic coding sequence
atgaccgaccacagcatcaaggagtgccagaagagcctggacttcgtgctgggctggttcgccaagcccgtgttcatcgacggcgactaccccgagagcatgaagaacaacctgagcagcatcctgcccgacttcaccgagagcgagaagaagttcatcaagggcaccgccgacttcttcgccctgtgcttcggccccaccctgagcttccagctgctggacccccacatgaagttcagacagctggagagccccaacctgagacagctgctgagctggatcgacctggagttcaaccacccccagatcttcatcgtggagaacggctggttcgtgagcggcaccaccaagagagacgacgccaagtacatgtactacctgaagaagttcatcatggagaccctgaaggccatcaagctggacggcgtggacgtgatcggctacaccgcctggagcctgatggacggcttcgagtggcacagaggctacagcatcagaagaggcctgttctacgtggacttcctgagccaggacaagatgctgctgcccaagagcagcgccctgttctaccagaagctgatcgagaagaacggcttcccccccctgcccgagaaccagcccctggagggcaccttcccctgcgacttcgcctggggcgtggtggacaactacatccaggtgagccagctgaccaagcccatcagcagcctgaccaagccctaccactag

SEQ ID NO: 2021 - DNA, 1440 bp, Artificial Sequence
  Description of Artificial Sequence: Synthetic coding sequence
atgagacagccccccggcgagagcgacatggccgtgagcgacgccctgctgcccagcttcagcaccttcgccagcggccccgccggcagagagaagaccctgagacaggccggcgcccccaacaacagatggagagaggagctgagccacatgaagagactgccccccgtgctgcccggcagaccctacgacctggccgccgccaccgtggccaccgacctggagagcggcggcgccggcgccgcctgcggcggcagcaacctggcccccctgcccagaagagagaccgaggagttcaacgacctgctggacctggacttcatcctgagcaacagcctgacccacccccccgagagcgtggccgccaccgtgagcagcagcgccagcgccagcagcagcagcagccccagcagcagcggccccgccagcgcccccagcacctgcagcttcacctaccccatcagagccggcaacgaccccggcgtggcccccggcggcaccggcggcggcctgctgtacggcagagagagcgcccccccccccaccgcccccttcaacctggccgacatcaacgacgtgagccccagcggcggcttcgtggccgagctgctgagacccgagctggaccccgtgtacatccccccccagcagccccagccccccggcggcggcctgatgggcaagttcgtgctgaaggccagcctgagcgcccccggcagcgagtacggcagccccagcgtgatcagcgtgagcaagggcagccccgacggcagccaccccgtggtggtggccccctacaacggcggcccccccagaacctgccccaagatcaagcaggaggccgtgagcagctgcacccacctgggcgccggcccccccctgagcaacggccacagacccgccgcccacgacttccccctgggcagacagctgcccagcagaaccacccccaccctgggcctggaggaggtgctgagcagcagagactgccaccccgccctgcccctgccccccggcttccacccccaccccggccccaactaccccagcttcctgcccgaccagatgcagccccaggtgccccccctgcactaccaggagctgatgccccccggcagctgcatgcccgaggagcccaagcccaagagaggcagaagaagctggcccagaaagagaaccgccacccacacctgcgactacgccggctgcggcaagacctacaccaagagcagccacctgaaggcccacctgagaacccacaccggcgagaagccctaccactgcgactgggacggctgcggctggaagttcgccagaagcgacgagctgaccagacactacagaaagcacaccggccacagacccttccagtgccagaagtgcgacagagccttcagcagaagcgaccacctggccctgcacatgaagagacacttctag

SEQ ID NO: 2022 - DNA, 699 bp, Artificial Sequence
  Description of Artificial Sequence: Synthetic coding sequence
atggccgtgagcgacgccctgctgcccagcttcagcaccttcgccagcggccccgccggcagagagaagaccctgagacaggccggcgcccccaacaacagatggagagaggagctgagccacatgaagagactgccccccgtgctgcccggcagaccctacgacctggccgccgccaccgtggccaccgacctggagagcggcggcgccggcgccgcctgcggcggcagcaacctggcccccctgcccagaagagagaccgaggagttcaacgacctgctggacctggacttcatcctgagcaacagcctgacccacccccccgagagcgtggccgccaccgtgagcagcagcgccagcgccagcagcagcagcagccccagcagcagcggccccgccagcgcccccagcacctgcagcttcacctaccccatcagagccggcaacgaccccggcgtggcccccggcggcaccggcggcggcctgctgtacggcagagagagcgcccccccccccaccgcccccttcaacctggccgacatcaacgacgtgagccccagcggcggcttcgtggccgagctgctgagacccgagctggaccccgtgtacatccccccccagcagccccagccccccggcggcggcctgatgggcaagttcgtgctgaaggccagcctgagcgcccccggcagcgagtag

SEQ ID NO: 2023 - DNA, 69 bp, Artificial Sequence
  Description of Artificial Sequence: Synthetic coding sequence
atgagacagccccccggcgagagcgacatggccgtgagcgacgccctgctgcccagcttcagcacctag

SEQ ID NO: 2024 - DNA, 117 bp, Artificial Sequence
  Description of Artificial Sequence: Synthetic coding sequence
atgagacagccccccggcgagagcgacatggccgtgagcgacgccctgctgcccagcttcagcaccttcgccagcggccccgccggcagagagaagaccctgagacaggccggctag

SEQ ID NO: 2025 - DNA, 1323 bp, Artificial Sequence
  Description of Artificial Sequence: Synthetic coding sequence
atgggcccccccggcagcccctggcagtgggtgaccctgctgctgggcctgctgctgccccccgccgcccccttctggctgctgaacgtgctgttccccccccacaccacccccaaggccgagctgagcaaccacaccagacccgtgatcctggtgcccggctgcctgggcaaccagctggaggccaagctggacaagcccgacgtggtgaactggatgtgctacagaaagaccgaggacttcttcaccatctggctggacctgaacatgttcctgcccctgggcgtggactgctggatcgacaacaccagagtggtgtacaacagaagcagcggcctggtgagcaacgcccccggcgtgcagatcagagtgcccggcttcggcaagacctacagcgtggagtacctggacagcagcaagctggccggctacctgcacaccctggtgcagaacctggtgaacaacggctacgtgagagacgagaccgtgagagccgccccctacgactggagactggagcccggccagcaggaggagtactacagaaagctggccggcctggtggaggagatgcacgccgcctacggcaagcccgtgttcctgatcggccacagcctgggctgcctgcacctgctgtacttcctgctgagacagccccaggcctggaaggacagattcatcgacggcttcatcagcctgggcgccccctggggcggcagcatcaagcccatgctggtgctggccagcggcgacaaccagggcatccccatcatgagcagcatcaagctgaaggaggagcagagaatcaccaccaccagcccctggatgttccccagcagaatggcctggcccgaggaccacgtgttcatcagcacccccagcttcaactacaccggcagagacttccagagattcttcgccgacctgcacttcgaggagggctggtacatgtggctgcagagcagagacctgctggccggcctgcccgcccccggcgtggaggtgtactgcctgtacggcgtgggcctgcccacccccagaacctacatctacgaccacggcttcccctacaccgaccccgtgggcgtgctgtacgaggacggcgacgacaccgtggccaccagaagcaccgagctgtgcggcctgtggcagggcagacagccccagcccgtgcacctgctgcccctgcacggcatccagcacctgaacatggtgttcagcaacctgaccctggagcacatcaacgccatcctgctgggcgcctacagacagggcccccccgccagccccaccgccagccccgagccccccccccccgagtag

SEQ ID NO: 2026 - DNA, 753 bp, Artificial Sequence
  Description of Artificial Sequence: Synthetic coding sequence
atggccgacaacttcagcctgcacgacgccctgagcggcagcggcaaccccaacccccagggctggcccggcgcctggggcaaccagcccgccggcgccggcggctaccccggcgccagctaccccggcgcctaccccggccaggccccccccggcgcctaccccggccaggccccccccggcgcctaccccggcgcccccggcgcctaccccggcgcccccgcccccggcgtgtaccccggcccccccagcggccccggcgcctaccccagcagcggccagcccagcgccaccggcgcctaccccgccaccggcccctacggcgcccccgccggccccctgatcgtgccctacaacctgcccctgcccggcggcgtggtgcccagaatgctgatcaccatcctgggcaccgtgaagcccaacgccaacagaatcgccctggacttccagagaggcaacgacgtggccttccacttcaaccccagattcaacgagaacaacagaagagtgatcgtgtgcaacaccaagctggacaacaactggggcagagaggagagacagagcgtgttccccttcgagagcggcaagcccttcaagatccaggtgctggtggagcccgaccacttcaaggtggccgtgaacgacgcccacctgctgcagtacaaccacagagtgaagaagctgaacgagatcagcaagctgggcatcagcggcgacatcgacctgaccagcgccagctacaccatgatctag

SEQ ID NO: 2027 - DNA, 630 bp, Artificial Sequence
  Description of Artificial Sequence: Synthetic coding sequence
atgggcagcgtgagcaaccagcagttcgccggcggctgcgccaaggccgccgaggaggcccccgaggaggcccccgaggacgccgccagagccgccgacgagccccagctgctgcacggcgccggcatctgcaagtggttcaacgtgagaatgggcttcggcttcctgagcatgaccgccagagccggcgtggccctggacccccccgtggacgtgttcgtgcaccagagcaagctgcacatggagggcttcagaagcctgaaggagggcgaggccgtggagttcaccttcaagaagagcgccaagggcctggagagcatcagagtgaccggccccggcggcgtgttctgcatcggcagcgagagaagacccaagggcaagagcatgcagaagagaagaagcaagggcgacagatgctacaactgcggcggcctggaccaccacgccaaggagtgcaagctgcccccccagcccaagaagtgccacttctgccagagcatcagccacatggtggccagctgccccctgaaggcccagcagggccccagcgcccagggcaagcccacctacttcagagaggaggaggaggagatccacagccccaccctgctgcccgaggcccagaactag

SEQ ID NO: 2028 - DNA, 630 bp, Artificial Sequence; identical to SEQ ID NO: 2027
  Description of Artificial Sequence: Synthetic coding sequence

SEQ ID NO: 2029 - DNA, 660 bp, Artificial Sequence
  Description of Artificial Sequence: Synthetic coding sequence
atgaagatgagattcctgggcctggtggtgtgcctggtgctgtggaccctgcacagcgagggcagcggcggcaagctgaccgccgtggaccccgagaccaacatgaacgtgagcgagatcatcagctactggggcttccccagcgaggagtacctggtggagaccgaggacggctacatcctgtgcctgaacagaatcccccacggcagaaagaaccacagcgacaagggccccaagcccgtggtgttcctgcagcacggcctgctggccgacagcagcaactgggtgaccaacctggccaacagcagcctgggcttcatcctggccgacgccggcttcgacgtgtggatgggcaacagcagaggcaacacctggagcagaaagcacaagaccctgagcgtgagccaggacgagttctgggccttcagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagagaatcaagatgttcttcgccctgggccccgtggccagcgtggccttctgcaccagccccatggccaagctgggcagactgtag

SEQ ID NO: 2030 - DNA, 1200 bp, Artificial Sequence
  Description of Artificial Sequence: Synthetic coding sequence
atgaagatgagattcctgggcctggtggtgtgcctggtgctgtggaccctgcacagcgagggcagcggcggcaagctgaccgccgtggaccccgagaccaacatgaacgtgagcgagatcatcagctactggggcttccccagcgaggagtacctggtggagaccgaggacggctacatcctgtgcctgaacagaatcccccacggcagaaagaaccacagcgacaagggccccaagcccgtggtgttcctgcagcacggcctgctggccgacagcagcaactgggtgaccaacctggccaacagcagcctgggcttcatcctggccgacgccggcttcgacgtgtggatgggcaacagcagaggcaacacctggagcagaaagcacaagaccctgagcgtgagccaggacgagttctgggccttcagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagagaatcaagatgttcttcgccctgggccccgtggccagcgtggccttctgcaccagccccatggccaagctgggcagactgcccgaccacctgatcaaggacctgttcggcgacaaggagttcctgccccagagcgccttcctgaagtggctgggcacccacgtgtgcacccacgtgatcctgaaggagctgtgcggcaacctgtgcttcctgctgtgcggcttcaacgagagaaacctgaacatgagcagagtggacgtgtacaccacccacagccccgccggcaccagcgtgcagaacatgctgcactggagccaggccgtgaagttccagaagttccaggccttcgactggggcagcagcgccaagaactacttccactacaaccagagctacccccccacctacaacgtgaaggacatgctggtgcccaccgccgtgtggagcggcggccacgactggctggccgacgtgtacgacgtgaacatcctgctgacccagatcaccaacctggtgttccacgagagcatccccgagtgggagcacctggacttcatctggggcctggacgccccctggagactgtacaacaagatcatcaacctgatgagaaagtaccagtag

SEQ ID NO: 2031 - DNA, 1074 bp, Artificial Sequence
  Description of Artificial Sequence: Synthetic coding sequence
atgaagctgagaaccctggccgtgagcgccaccgtggtgaaggacggcgtgagcggcgtgtgcagcttcagatgcagcgacgtgagcggcgtgctgcccagcggccccaagcccgtggtgttcctgcagcacggcctgctggccgacagcagcaactgggtgaccaacctggccaacagcagcctgggcttcatcctggccgacgccggcttcgacgtgtggatgggcaacagcagaggcaacacctggagcagaaagcacaagaccctgagcgtgagccaggacgagttctgggccttcagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagagaatcaagatgttcttcgccctgggccccgtggccagcgtggccttctgcaccagccccatggccaagctgggcagactgcccgaccacctgatcaaggacctgttcggcgacaaggagttcctgccccagagcgccttcctgaagtggctgggcacccacgtgtgcacccacgtgatcctgaaggagctgtgcggcaacctgtgcttcctgctgtgcggcttcaacgagagaaacctgaacatgagcagagtggacgtgtacaccacccacagccccgccggcaccagcgtgcagaacatgctgcactggagccaggccgtgaagttccagaagttccaggccttcgactggggcagcagcgccaagaactacttccactacaaccagagctacccccccacctacaacgtgaaggacatgctggtgcccaccgccgtgtggagcggcggccacgactggctggccgacgtgtacgacgtgaacatcctgctgacccagatcaccaacctggtgttccacgagagcatccccgagtgggagcacctggacttcatctggggcctggacgccccctggagactgtacaacaagatcatcaacctgatgagaaagtaccagtag

SEQ ID NO: 2032 - DNA, 1200 bp, Artificial Sequence; identical to SEQ ID NO: 2030
  Description of Artificial Sequence: Synthetic coding sequence

SEQ ID NO: 2033 - DNA, 1032 bp, Artificial Sequence
  Description of Artificial Sequence: Synthetic coding sequence
atggcctgcctggagttcgtgcccttcgacgtgcagatgtgcctggagttcctgcccagcggccccaagcccgtggtgttcctgcagcacggcctgctggccgacagcagcaactgggtgaccaacctggccaacagcagcctgggcttcatcctggccgacgccggcttcgacgtgtggatgggcaacagcagaggcaacacctggagcagaaagcacaagaccctgagcgtgagccaggacgagttctgggccttcagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagagaatcaagatgttcttcgccctgggccccgtggccagcgtggccttctgcaccagccccatggccaagctgggcagactgcccgaccacctgatcaaggacctgttcggcgacaaggagttcctgccccagagcgccttcctgaagtggctgggcacccacgtgtgcacccacgtgatcctgaaggagctgtgcggcaacctgtgcttcctgctgtgcggcttcaacgagagaaacctgaacatgagcagagtggacgtgtacaccacccacagccccgccggcaccagcgtgcagaacatgctgcactggagccaggccgtgaagttccagaagttccaggccttcgactggggcagcagcgccaagaactacttccactacaaccagagctacccccccacctacaacgtgaaggacatgctggtgcccaccgccgtgtggagcggcggccacgactggctggccgacgtgtacgacgtgaacatcctgctgacccagatcaccaacctggtgttccacgagagcatccccgagtgggagcacctggacttcatctggggcctggacgccccctggagactgtacaacaagatcatcaacctgatgagaaagtaccagtag

SEQ ID NO: 2034 - DNA, 1206 bp, Artificial Sequence
  Description of Artificial Sequence: Synthetic coding sequence
atggcctgcctggagttcgtgcccttcgacgtgcagatgtgcctggagttcctgcccagcggcgagttcgtggtgctgctgaccagcggcgtgcagctgcagaccttcaccgtgagcgtgaccgacctgaagggcggcgccagcggcgtggtgagaagcagcagatgggtgagaggcttcaccgacttcagaagcaaggccgtggacctgtgcggccccaagcccgtggtgttcctgcagcacggcctgctggccgacagcagcaactgggtgaccaacctggccaacagcagcctgggcttcatcctggccgacgccggcttcgacgtgtggatgggcaacagcagaggcaacacctggagcagaaagcacaagaccctgagcgtgagccaggacgagttctgggccttcagagtgcccttcctggactacagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagagaatcaagatgttcttcgccctgggccccgtggccagcgtggccttctgcaccagccccatggccaagctgggcagactgcccgaccacctgatcaaggacctgttcggcgacaaggagttcctgccccagagcgccttcctgaagtggctgggcacccacgtgtgcacccacgtgatcctgaaggagctgtgcggcaacctgtgcttcctgctgtgcggcttcaacgagagaaacctgaacatgagcagagtggacgtgtacaccacccacagccccgccggcaccagcgtgcagaacatgctgcactggagccaggccgtgaagttccagaagttccaggccttcgactggggcagcagcgccaagaactacttccactacaaccagagctacccccccacctacaacgtgaaggacatgctggtgcccaccgccgtgtggagcggcggccacgactggctggccgacgtgtacgacgtgaacatcctgctgacccagatcaccaacctggtgttccacgagagcatccccgagtgggagcacctggacttcatctggggcctggacgccccctggagactgtacaacaagatcatcaacctgatgagaaagtaccagtag

SEQ ID NO: 2035 - DNA, 873 bp, Artificial Sequence
  Description of Artificial Sequence: Synthetic coding sequence
atgaagatgagattcctgggcctggtggtgtgcctggtgctgtggaccctgcacagcgagggcagcggcggcaagctgaccgccgtggaccccgagaccaacatgaacgtgagcgagatcatcagctactggggcttccccagcgaggagtacctggtggagaccgaggacggctacatcctgtgcctgaacagaatcccccacggcagaaagaaccacagcgacaagggccccaagcccgtggtgttcctgcagcacggcctgctggccgacagcagcaactgggtgaccaacctggccaacagcagcctgggcttcatcctggccgacgccggcttcgacgtgtggatgggcaacagcagaggcaacacctggagcagaaagcacaagaccctgagcgtgagccaggacgagttctgggccttcagctacgacgagatggccaagtacgacctgcccgccagcatcaacttcatcctgaacaagaccggccaggagcaggtgtactacgtgggccacagccagggcaccaccatcggcttcatcgccttcagccagatccccgagctggccaagagaatcaagatgttcttcgccctgggccccgtggccagcgtggccttctgcaccagccccatggccaagctgggcagactgcccgaccacctgatcaaggacctgttcggcgacaaggagttcctgccccagagcgccttcctgaagtggctgggcacccacgtgtgcacccacgtgatcctgaaggagctgtgcggcaacctgtgcttcctgctgtgcggcttcaacgagagaaacctgaacatgagcagagtggacgtgtacaccacccacagccccgccggcaccagcgtgtag

SEQ ID NO: 2036 - DNA, 1200 bp, Artificial Sequence; identical to SEQ ID NO: 2030
  Description of Artificial Sequence: Synthetic coding sequence

SEQ ID NO: 2037 - DNA, 87 bp, Artificial Sequence
  Description of Artificial Sequence: Synthetic coding sequence
ctgtgcttcctgctgtgcggcttcaacgagagaaacctgaacatggccgtgaagttccagaagttccaggccttcgactggggctag

SEQ ID NO: 2038 - DNA, 1200 bp, Artificial Sequence; identical to SEQ ID NO: 2030
  Description of Artificial Sequence: Synthetic coding sequence

SEQ ID NO: 2039 - DNA, 411 bp, Artificial Sequence
  Description of Artificial Sequence: Synthetic coding sequence
atgaagatgagattcctgggcctggtggtgtgcctggtgctgtggaccctgcacagcgagggcagcggcggcaagctgaccgccgtggaccccgagaccaacatgaacgtgagcgagatcatcagctactggggcttccccagcgaggagtacctggtggagaccgaggacggctacatcctgtgcctgaacagaatcccccacggcagaaagaaccacagcgacaagggccccaagcccgtggtgttcctgcagcacggcctgctggccgacagcagcaactgggtgaccaacctggccaacagcagcctgggcttcatcctggccgacgccggcttcgacgtgtggatgggcaacagcagaggcaacacctggagcagaaagcacgtgaccctggagcccggctgctag

SEQ ID NO: 2040 - DNA, 1428 bp, Artificial Sequence
  Description of Artificial Sequence: Synthetic coding sequence
atggagagcaaggccctgctggtgctgaccctggccgtgtggctgcagagcctgaccgccagcagaggcggcgtggccgccgccgaccagagaagagacttcatcgacatcgagagcaagttcgccctgagaacccccgaggacaccgccgaggacacctgccacctgatccccggcgtggccgagagcgtggccacctgccacttcaaccacagcagcaagaccttcatggtgatccacggctggaccgtgaccggcatgtacgagagctgggtgcccaagctggtggccgccctgtacaagagagagcccgacagcaacgtgatcgtggtggactggctgagcagagcccaggagcactaccccgtgagcgccggctacaccaagctggtgggccaggacgtggccagattcatcaactggatggaggaggagttcaactaccccctggacaacgtgcacctgctgggctacagcctgggcgcccacgccgccggcatcgccggcagcctgaccaacaagaaggtgaacagaatcaccggcctggaccccgccggccccaacttcgagtacgccgaggcccccagcagactgagccccgacgacgccgacttcgtggacgtgctgcacaccttcaccagaggcagccccggcagaagcatcggcatccagaagcccgtgggccacgtggacatctaccccaacggcggcaccttccagcccggctgcaacatcggcgaggccatcagagtgatcgccgagagaggcctgggcgacgtggaccagctggtgaagtgcagccacgagagaagcatccacctgttcatcgacagcctgctgaacgaggagaaccccagcaaggcctacagatgcagcagcaaggaggccttcgagaagggcctgtgcctgagctgcagaaagaacagatgcaacaacctgggctacgagatcaacaaggtgagagccaagagaagcagcaagatgtacctgaagaccagaagccagatgccctacaaggtgttccactaccaggtgaagatccacttcagcggcaccgagagcgagacccacaccaaccaggccttcgagatcagcctgtacggcaccgtggccgagagcgagaacatccccttcaccctgcccgaggtgagcaccaacaagacctacagcttcctgatctacaccgaggtggacatcggcgagctgctgatgctgaagctgaagtggaagagcgacagctacttcagctggagcgactggtggagcagccccggcttcgccatccagaagatcagagtgaaggccggcgagacccagaagaaggtgatcttctgcagcagagagaaggtgagccacctgcagaagggcaaggcccccgccgtgttcgtgaagtgccacgacaagagcctgaacaagaagagcggctag

SEQ ID NO: 2041 - DNA, 348 bp, Artificial Sequence
  Description of Artificial Sequence: Synthetic coding sequence
atggtgatccacggctggaccgtgaccggcatgtacgagagctgggtgcccaagctggtggccgccctgtacaagagagagcccgacagcaacgtgatcgtggtggactggctgagcagagcccaggagcactaccccgtgagcgccggctacaccaagctggtgggccaggacgtggccagattcatcaactggatggaggaggagttcaactaccccctggacaacgtgcacctgctgggctacagcctgggcgcccacgccgccggcatcgccggcagcctgaccaacaagaaggtgaacagaatcaccggcctggaccccgccggccccaacttcgagtactag

SEQ ID NO: 2042 - DNA, 321 bp, Artificial Sequence
  Description of Artificial Sequence: Synthetic coding sequence
atggagagcaaggccctgctggtgctgaccctggccgtgtggctgcagagcctgaccgccagcagaggcggcgtggccgccgccgaccagagaagagacttcatcgacatcgagagcaagttcgccctgagaacccccgaggacaccgccgaggacacctgccacctgatccccggcgtggccgagagcgtggccacctgccacttcaaccacagcagcaagaccttcatggtgatccacggctggaccgtgaccggcatgtacgagagctgggtgcccaagctggtggccgccctgtacaagagagagcccgacagctag

SEQ ID NO: 2043 - DNA, 393 bp, Artificial Sequence
  Description of Artificial Sequence: Synthetic coding sequence
atggagagcaaggccctgctggtgctgaccctggccgtgtggctgcagagcctgaccgccagcagaggcggcgtggccgccgccgaccagagaagagacttcatcgacatcgagagcaagttcgccctgagaacccccgaggacaccgccgaggacacctgccacctgatccccggcgtggccgagagcgtggccacctgccacttcaaccacagcagcaagaccttcatggtgatccacggctggaccgtgaccggcatgtacgagagctgggtgcccaagctggtggccgccctgtacaagagagagcccgacagcaacgtgatcgtggtggactggctgagcagagcccaggagcactaccccgtgagcgccggctacaccaagctgtag

SEQ ID NO: 2044 - DNA, 1386 bp, Artificial Sequence
  Description of Artificial Sequence: Synthetic coding sequence
atggagagcaaggccctgctggtgctgaccctggccgccgccgaccagagaagagacttcatcgacatcgagagcaagttcgccctgagaacccccgaggacaccgccgaggacacctgccacctgatccccggcgtggccgagagcgtggccacctgccacttcaaccacagcagcaagaccttcatggtgatccacggctggaccgtgaccggcatgtacgagagctgggtgcccaagctggtggccgccctgtacaagagagagcccgacagcaacgtgatcgtggtggactggctgagcagagcccaggagcactaccccgtgagcgccggctacaccaagctggtgggccaggacgtggccagattcatcaactggatggaggaggagttcaactaccccctggacaacgtgcacctgctgggctacagcctgggcgcccacgccgccggcatcgccggcagcctgaccaacaagaaggtgaacagaatcaccggcctggaccccgccggccccaacttcgagtacgccgaggcccccagcagactgagccccgacgacgccgacttcgtggacgtgctgcacaccttcaccagaggcagccccggcagaagcatcggcatccagaagcccgtgggccacgtggacatctaccccaacggcggcaccttccagcccggctgcaacatcggcgaggccatcagagtgatcgccgagagaggcctgggcgacgtggaccagctggtgaagtgcagccacgagagaagcatccacctgttcatcgacagcctgctgaacgaggagaaccccagcaaggcctacagatgcagcagcaaggaggccttcgagaagggcctgtgcctgagctgcagaaagaacagatgcaacaacctgggctacgagatcaacaaggtgagagccaagagaagcagcaagatgtacctgaagaccagaagccagatgccctacaaggtgttccactaccaggtgaagatccacttcagcggcaccgagagcgagacccacaccaaccaggccttcgagatcagcctgtacggcaccgtggccgagagcgagaacatccccttcaccctgcccgaggtgagcaccaacaagacctacagcttcctgatctacaccgaggtggacatcggcgagctgctgatgctgaagctgaagtggaagagcgacagctacttcagctggagcgactggtggagcagccccggcttcgccatccagaagatcagagtgaaggccggcgagacccagaagaaggtgatcttctgcagcagagagaaggtgagccacctgcagaagggcaaggcccccgccgtgttcgtgaagtgccacgacaagagcctgaacaagaagagcggctag

SEQ ID NO: 2045 - DNA, 828 bp, Artificial Sequence
  Description of Artificial Sequence: Synthetic coding sequence
atggtgatccacggctggaccgtgaccggcatgtacgagagctgggtgcccaagctggtggccgccctgtacaagagagagcccgacagcaacgtgatcgtggtggactggctgagcagagcccaggagcactaccccgtgagcgccggctacaccaagctggtgggccaggacgtggccagattcatcaactggatggaggaggagttcaactaccccctggacaacgtgcacctgctgggctacagcctgggcgcccacgccgccggcatcgccggcagcctgaccaacaagaaggtgaacagaatcaccggcctggaccccgccggccccaacttcgagtacgccgaggcccccagcagactgagccccgacgacgccgacttcgtggacgtgctgcacaccttcaccagaggcagccccggcagaagcatcggcatccagaagcccgtgggccacgtggacatctaccccaacggcggcaccttccagcccggctgcaacatcggcgaggccatcagagtgatcgccgagagaggcctgggcgacgtggaccagctggtgaagtgcagccacgagagaagcatccacctgttcatcgacagcctgctgaacgaggagaaccccagcaaggcctacagatgcagcagcaaggaggccttcgagaagggcctgtgcctgagctgcagaaagaacagatgcaacaacctgggctacgagatcaacaaggtgagagccaagagaagcagcaagatgtacgaggacagcttcagcgacgccctgcagagcctgcccctgcccagcaaggacagcttcttctgggactag

SEQ ID NO: 2046 - DNA, 2079 bp, Artificial Sequence
  Description of Artificial Sequence: Synthetic coding sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgcctgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 2047 - DNA, 2460 bp, Artificial Sequence
  Description of Artificial Sequence: Synthetic coding sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcagccccaagacctgcagccaggacgagttcagatgccacgacggcaagtgcatcagcagacagttcgtgtgcgacagcgacagagactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 2048 - DNA, 2049 bp, Artificial Sequence
  Description of Artificial Sequence: Synthetic coding sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgccccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagagaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 2049 - DNA, 2577 bp, Artificial Sequence
  Description of Artificial Sequence: Synthetic coding sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgcccccccaagacctgcagccaggacgagttcagatgccacgacggcaagtgcatcagcagacagttcgtgtgcgacagcgacagagactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcatggtgagcctggaggacgacgtggcctag

SEQ ID NO: 2050 - DNA, 2583 bp, Artificial Sequence
  Description of Artificial Sequence: Synthetic coding sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgcccccccaagacctgcagccaggacgagttcagatgccacgacggcaagtgcatcagcagacagttcgtgtgcgacagcgacagagactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 2051 - DNA, 2220 bp, Artificial Sequence
  Description of Artificial Sequence: Synthetic coding sequence
atgggcccctggggctggaagctgagatggaccgtggccctgctgctggccgccgccggcaccgccgtgggcgacagatgcgagagaaacgacttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 2052 - DNA, 2838 bp, Artificial Sequence
  Description of Artificial Sequence: Synthetic coding sequence
tgaggcagacccggcgtgccccccagattcctgagccagagaagaagacaggtgcccggccccagaagcagactgagagacatccacgagagccccagcgtgatcctgggcccccccggcgaggtgcccggcttcagatgcgccctgtggagacacctgagaccccacctggtgctgggcggcgccctggccccccccgcccccatcaagttcaccgagggcccccccgccaccctgaaggccagcgtgccctacgaggtggagaccctgccccagaacctgcccgcccccccctggagcgccgccgagatcttcagccacgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgcccccccaagacctgcagccaggacgagttcagatgccacgacggcaagtgcatcagcagacagttcgtgtgcgacagcgacagagactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 2053 - DNA, 1770 bp, Artificial Sequence
  Description of Artificial Sequence: Synthetic coding sequence
atgagcagaagactgctgcccagagccgagaagagaagaagaagactggagcagagacagcagcccgacgagcagagaagaagaagcggcgccatggtgaagatggccgccgccggcggcggcggcggcggcggcagatactacggcggcggcagcgagggcggcagagcccccaagagactgaagaccgacaacgccggcgaccagcacggcggcggcggcggcggcggcggcggcgccggcgccgccggcggcggcggcggcggcgagaactacgacgacccccacaagacccccgccagccccgtggtgcacatcagaggcctgatcgacggcgtggtggaggccgacctggtggaggccctgcaggagttcggccccatcagctacgtggtggtgatgcccaagaagagacaggccctggtggagttcgaggacgtgctgggcgcctgcaacgccgtgaactacgccgccgacaaccagatctacatcgccggccaccccgccttcgtgaactacagcaccagccagaagatcagcagacccggcgacagcgacgacagcagaagcgtgaacagcgtgctgctgttcaccatcctgaaccccatctacagcatcaccaccgacgtgctgtacaccatctgcaacccctgcggccccgtgcagagaatcgtgatcttcagaaagaacggcgtgcaggccatggtggagttcgacagcgtgcagagcgcccagagagccaaggccagcctgaacggcgccgacatctacagcggctgctgcaccctgaagatcgagtacgccaagcccaccagactgaacgtgttcaagaacgaccaggacacctgggactacaccaaccccaacctgagcggccagggcgaccccggcagcaaccccaacaagagacagagacagccccccctgctgggcgaccaccccgccgagtacggcggcccccacggcggctaccacagccactaccacgacgagggctacggccccccccccccccactacgagggcagaagaatgggcccccccgtgggcggccacagaagaggccccagcagatacggcccccagtacggccacccccccccccccccccccccccccgagtacggcccccacgccgacagccccgtgctgatggtgtacggcctggaccagagcaagatgaactgcgacagagtgttcaacgtgttctgcctgtacggcaacgtggagaaggtgaagttcatgaagagcaagcccggcgccgccatggtggagatggccgacggctacgccgtggacagagccatcacccacctgaacaacaacttcatgttcggccagaagctgaacgtgtgcgtgagcaagcagcccgccatcatgcccggccagagctacggcctggaggacggcagctgcagctacaaggacttcagcgagagcagaaacaacagattcagcacccccgagcaggccgccaagaacagaatccagcaccccagcaacgtgctgcacttcttcaacgcccccctggaggtgaccgaggagaacttcttcgagatctgcgacgagctgggcgtgaagagacccagcagcgtgaaggtgttcagcggcaagagcgagagaagcagcagcggcctgctggagtgggagagcaagagcgacgccctggagaccctgggcttcctgaaccactaccagatgaagaaccccaacggcccctacccctacaccctgaagctgtgcttcagcaccgcccagcacgccagctag

SEQ ID NO: 2054 - DNA, 540 bp, Artificial Sequence
  Description of Artificial Sequence: Synthetic coding sequence
atgggcagacccggcctgggcgccgccgtgagcgacctgggcgaggccgtgagcctgagccagggcctgctgctgctgctgctgctgagcatgggcggcgcctgggccagcagagagcccctgagaccctggtgccaccccatcaacgccatcctggccgtggagaaggagggctgccccgtgtgcatcaccgtgaacaccaccatctgcgccggctactgccccaccatgatgagagtgctgcaggccgtgctgccccccctgccccaggtggtgtgcacctacagagacgtgagattcgagagcatcagactgcccggctgccccagaggcgtggaccccgtggtgagcttccccgtggccctgagctgcagatgcggcccctgcagaagaagcaccagcgactgcggcggccccaaggaccaccccctgacctgcgaccacccccagcaggccagcagcagcagcaaggacccccccagaagcctgcccagccccagcagactgctggagcccgacacccccatcctgccccagtag

SEQ ID NO: 2055 - DNA, 294 bp, Artificial Sequence
  Description of Artificial Sequence: Synthetic coding sequence
atgcagctgggcaccggcctgctgctggccgccgtgctgagcctgcagctggccgccgccgaggccatctggtgccaccagtgcaccggcttcggcggctgcagccacggcagcagatgcctgagagacagcacccactgcgtgaccaccgccaccagagtgctgagcaacaccgaggacctgcccctggtgaccaagatgtgccacatcggctgccccgacatccccagcctgggcctgggcccctacgtgagcatcgcctgctgccagaccagcctgtgcaaccacgactag

SEQ ID NO: 2056 - DNA, 2058 bp, Artificial Sequence
  Description of Artificial Sequence: Synthetic coding sequence
atgcccgcctacacccacgccagccccatccacaacacccacaagccctacgagtgcaaggagtgcggcaagtacttcagctgcggcagcaacctgatccagcaccagagcatccacaccggcgagaagccctacaagtgcaaggagtgcggcaaggccttccagctgcacatccagctgaccagacaccagaagttccacaccggcgagaagaccttcgagtgcaaggagtgcggcaaggccttcaacctgcccacccagctgaacagacacaagaacatccacaccgtgaagaagctgttcgagtgcaaggagtgcggcaagagcttcaacagaagcagcaacctgacccagcaccagagcatccacgccggcgtgaagccctaccagtgcaaggagtgcggcaaggccttcaacagaggcagcaacctgatccagcaccagaagatccacagcaacgagaagcccttcgtgtgcagagagtgcgagatggccttcagataccactaccagctgatcgagcactgcagaatccacaccggcgagaagcccttcgagtgcaaggagtgcagaaaggccttcaccctgctgaccaagctggtgagacaccagaagatccacatgggcgagaagcccttcgagtgcagagagtgcggcaaggccttcagcctgctgaaccagctgaacagacacaagaacatccacaccggcgagaagcccttcgagtgcaaggagtgcggcaagagcttcaacagaagcagcaacctgatccagcaccagagcatccacgccgacgtgaagccctacgagtgcaaggagtgcggcaagggcttcaacagaggcgccaacctgatccagcaccagaagatccacagcaacgagaagcccttcgtgtgcagagagtgcgagatggccttcagataccactaccagctgatccagcactgccagatccacaccggcggcaagcccttcgagtgcaaggagtgcggcaaggccttcagcctgctgacccagctggccagacacaagaacatccacaccggcgagaagcccttcgagtgcaaggactgcggcaaggccttcaacagaggcagcaacctggtgcagcaccagagcatccacaccggcgagaagccctacgagtgcaaggagtgcggcaaggccttcagactgcacctgcagctgagccagcacgagaagacccacaccggcgagaagcccttcgagtgcaaggagtgcggcaagttcttcagaagaggcagcaacctgaaccagcacagaagcatccacaccggcaagaagcccttcgagtgcaaggagtgcggcaaggccttcagactgcacatgcacctgatcagacaccagaagttccacaccggcgagaagcccttcgagtgcaaggagtgcggcaaggccttcagcctgcacacccagctgaaccaccacaagaacatccacaccggcgagaagcccttcaagtgcaaggagtgcggcaagagcttcaacagagtgagcaacctggtgcagcaccagagcatccacgccggcgtgaagccctacgagtgcaaggagtgcggcaagggcttcagcagagtgagcaacctgatccagcaccagaagacccacagcagcgccaagcccttcgtgtgcaaggagtgcagaaagaccttcagataccactaccagctgaccgagcactacagaatccacaccggcgagaagcccttcgagtgcaaggagtgcggcaaggccttcggcctgctgacccagctggcccagcaccagatcatccacaccggcgagaagcccttcaagtgcaaggagtgcggcaaggccttcaacagaggcagcaacctggtgcagccccagagcatccacaccggcgagaagccctacgagtgcaaggagtgcggcaaggccttcagactgcacctgcagctgagcctgcaccagaagctggtgcaggtgagaaaccccctgaacgtgagaaacgtgggccagcccagcgacatcagcagcaacctgctgaacatcagaaagttcatcctgggctag

SEQ ID NO: 2057 - DNA, 564 bp, Artificial Sequence
  Description of Artificial Sequence: Synthetic coding sequence
tgaagaggcggcggcgacagctacggcgtgctgctgagcaacgccctggccagactgagaggcttcaaggaccacttcaccttctgccagcagctgaacatcagcatctgccccctgagccagaccgccgccagattccaggtgatcgtgtacaaccccctgggcagaaaggtgaactggatggtgagactgcccgtgagcgagggcgtgttcgtggtgaaggaccccaacggcagaaccgtgcccagcgacgtggtgatcttccccagcagcgacagccaggcccacccccccgagctgctgttcagcgccagcctgcccgccctgggcttcagcacctacagcgtggcccaggtgcccagatggaagccccaggccagagccccccagcccatccccagaagaagctggagccccgccctgaccatcgagaacgagcacatcagagccaccttcgaccccgacaccggcctgctgatggagatcatgaacatgaaccagcagctgctgctgcccgtgagacagaccttcttctggtacaacgccagcatcggcgacaactag

SEQ ID NO: 2058 - DNA, 3036 bp, Artificial Sequence
  Description of Artificial Sequence: Synthetic coding sequence
atgggcgcctacgccagagccagcggcgtgtgcgccagaggctgcctggacagcgccggcccctggaccatgagcagagccctgagaccccccctgccccccctgtgcttcttcctgctgctgctggccgccgccggcgccagagccggcggctacgagacctgccccaccgtgcagcccaacatgctgaacgtgcacctgctgccccacacccacgacgacgtgggctggctgaagaccgtggaccagtacttctacggcatcaagaacgacatccagcacgccggcgtgcagtacatcctggacagcgtgatcagcgccctgctggccgaccccaccagaagattcatctacgtggagatcgccttcttcagcagatggtggcaccagcagaccaacgccacccaggaggtggtgagagacctggtgagacagggcagactggagttcgccaacggcggctgggtgatgaacgacgaggccgccacccactacggcgccatcgtggaccagatgaccctgggcctgagattcctggaggacaccttcggcaacgacggcagacccagagtggcctggcacatcgaccccttcggccacagcagagagcaggccagcctgttcgcccagatgggcttcgacggcttcttcttcggcagactggactaccaggacaagtgggtgagaatgcagaagctggagatggagcaggtgtggagagccagcaccagcctgaagccccccaccgccgacctgttcaccggcgtgctgcccaacggctacaacccccccagaaacctgtgctgggacgtgctgtgcgtggaccagcccctggtggaggaccccagaagccccgagtacaacgccaaggagctggtggactacttcctgaacgtggccaccgcccagggcagatactacagaaccaaccacaccgtgatgaccatgggcagcgacttccagtacgagaacgccaacatgtggttcaagaacctggacaagctgatcagactggtgaacgcccagcaggccaagggcagcagcgtgcacgtgctgtacagcacccccgcctgctacctgtgggagctgaacaaggccaacctgacctggagcgtgaagcacgacgacttcttcccctacgccgacggcccccaccagttctggaccggctacttcagcagcagacccgccctgaagagatacgagagactgagctacaacttcctgcaggtgtgcaaccagctggaggccctggtgggcctggccgccaacgtgggcccctacggcagcggcgacagcgcccccctgaacgaggccatggccgtgctgcagcaccacgacgccgtgagcggcaccagcagacagcacgtggccaacgactacgccagacagctggccgccggctggggcccctgcgaggtgctgctgagcaacgccctggccagactgagaggcttcaaggaccacttcaccttctgccagcagctgaacatcagcatctgccccctgagccagaccgccgccagattccaggtgatcgtgtacaaccccctgggcagaaaggtgaactggatggtgagactgcccgtgagcgagggcgtgttcgtggtgaaggaccccaacggcagaaccgtgcccagcgacgtggtgatcttccccagcagcgacagccaggcccacccccccgagctgctgttcagcgccagcctgcccgccctgggcttcagcacctacagcgtggcccaggtgcccagatggaagccccaggccagagccccccagcccatccccagaagaagctggagccccgccctgaccatcgagaacgagcacatcagagccaccttcgaccccgacaccggcctgctgatggagatcatgaacatgaaccagcagctgctgctgcccgtgagacagaccttcttctggtacaacgccagcatcggcgacaacgagagcgaccaggccagcggcgcctacatcttcagacccaaccagcagaagcccctgcccgtgagcagatgggcccagatccacctggtgaagacccccctggtgcaggaggtgcaccagaacttcagcgcctggtgcagccaggtggtgagactgtaccccggccagagacacctggagctggagtggagcgtgggccccatccccgtgggcgacacctggggcaaggaggtgatcagcagattcgacacccccctggagaccaagggcagattctacaccgacagcaacggcagagagatcctggagagaagaagagactacagacccacctggaagctgaaccagaccgagcccgtggccggcaactactaccccgtgaacaccagaatctacatcaccgacggcaacatgcagctgaccgtgctgaccgacagaagccagggcggcagcagcctgagagacggcagcctggagctgatggtgcacagaagactgctgaaggacgacggcagaggcgtgagcgagcccctgatggagaacggcagcggcgcctgggtgagaggcagacacctggtgctgctggacaccgcccaggccgccgccgccggccacagactgctggccgagcaggaggtgctggccccccaggtggtgctggcccccggcggcggcgccgcctacaacctgggcgccccccccagaacccagttcagcggcctgagaagagacctgccccccagcgtgcacctgctgaccctggccagctggggccccgagatggtgctgctgagactggagcaccagttcgccgtgggcgaggacagcggcagaaacctgagcgcccccgtgaccctgaacctgagagacctgttcagcaccttcaccatcaccagactgcaggagaccaccctggtggccaaccagctgagagaggccgccagcagactgaagtggaccaccaacaccggccccaccccccaccagaccccctaccagctggaccccgccaacatcaccctggagcccatggagatcagaaccttcctggccagcgtgcagtggaaggaggtggacggctag

SEQ ID NO: 2059 - DNA, 2853 bp, Artificial Sequence
  Description of Artificial Sequence: Synthetic coding sequence
atgctgaacgtgcacctgctgccccacacccacgacgacgtgggctggctgaagaccgtggaccagtacttctacggcatcaagaacgacatccagcacgccggcgtgcagtacatcctggacagcgtgatcagcgccctgctggccgaccccaccagaagattcatctacgtggagatcgccttcttcagcagatggtggcaccagcagaccaacgccacccaggaggtggtgagagacctggtgagacagggcagactggagttcgccaacggcggctgggtgatgaacgacgaggccgccacccactacggcgccatcgtggaccagatgaccctgggcctgagattcctggaggacaccttcggcaacgacggcagacccagagtggcctggcacatcgaccccttcggccacagcagagagcaggccagcctgttcgcccagatgggcttcgacggcttcttcttcggcagactggactaccaggacaagtgggtgagaatgcagaagctggagatggagcaggtgtggagagccagcaccagcctgaagccccccaccgccgacctgttcaccggcgtgctgcccaacggctacaacccccccagaaacctgtgctgggacgtgctgtgcgtggaccagcccctggtggaggaccccagaagccccgagtacaacgccaaggagctggtggactacttcctgaacgtggccaccgcccagggcagatactacagaaccaaccacaccgtgatgaccatgggcagcgacttccagtacgagaacgccaacatgtggttcaagaacctggacaagctgatcagactggtgaacgcccagcaggccaagggcagcagcgtgcacgtgctgtacagcacccccgcctgctacctgtgggagctgaacaaggccaacctgacctggagcgtgaagcacgacgacttcttcccctacgccgacggcccccaccagttctggaccggctacttcagcagcagacccgccctgaagagatacgagagactgagctacaacttcctgcaggtgtgcaaccagctggaggccctggtgggcctggccgccaacgtgggcccctacggcagcggcgacagcgcccccctgaacgaggccatggccgtgctgcagcaccacgacgccgtgagcggcaccagcagacagcacgtggccaacgactacgccagacagctggccgccggctggggcccctgcgaggtgctgctgagcaacgccctggccagactgagaggcttcaaggaccacttcaccttctgccagcagctgaacatcagcatctgccccctgagccagaccgccgccagattccaggtgatcgtgtacaaccccctgggcagaaaggtgaactggatggtgagactgcccgtgagcgagggcgtgttcgtggtgaaggaccccaacggcagaaccgtgcccagcgacgtggtgatcttccccagcagcgacagccaggcccacccccccgagctgctgttcagcgccagcctgcccgccctgggcttcagcacctacagcgtggcccaggtgcccagatggaagccccaggccagagccccccagcccatccccagaagaagctggagccccgccctgaccatcgagaacgagcacatcagagccaccttcgaccccgacaccggcctgctgatggagatcatgaacatgaaccagcagctgctgctgcccgtgagacagaccttcttctggtacaacgccagcatcggcgacaacgagagcgaccaggccagcggcgcctacatcttcagacccaaccagcagaagcccctgcccgtgagcagatgggcccagatccacctggtgaagacccccctggtgcaggaggtgcaccagaacttcagcgcctggtgcagccaggtggtgagactgtaccccggccagagacacctggagctggagtggagcgtgggccccatccccgtgggcgacacctggggcaaggaggtgatcagcagattcgacacccccctggagaccaagggcagattctacaccgacagcaacggcagagagatcctggagagaagaagagactacagacccacctggaagctgaaccagaccgagcccgtggccggcaactactaccccgtgaacaccagaatctacatcaccgacggcaacatgcagctgaccgtgctgaccgacagaagccagggcggcagcagcctgagagacggcagcctggagctgatggtgcacagaagactgctgaaggacgacggcagaggcgtgagcgagcccctgatggagaacggcagcggcgcctgggtgagaggcagacacctggtgctgctggacaccgcccaggccgccgccgccggccacagactgctggccgagcaggaggtgctggccccccaggtggtgctggcccccggcggcggcgccgcctacaacctgggcgccccccccagaacccagttcagcggcctgagaagagacctgccccccagcgtgcacctgctgaccctggccagctggggccccgagatggtgctgctgagactggagcaccagttcgccgtgggcgaggacagcggcagaaacctgagcgcccccgtgaccctgaacctgagagacctgttcagcaccttcaccatcaccagactgcaggagaccaccctggtggccaaccagctgagagaggccgccagcagactgaagtggaccaccaacaccggccccaccccccaccagaccccctaccagctggaccccgccaacatcaccctggagcccatggagatcagaaccttcctggccagcgtgcagtggaaggaggtggacggctag

SEQ ID NO: 2060 - DNA, 882 bp, Artificial Sequence
  Description of Artificial Sequence: Synthetic coding sequence
atgggcttccccgccgccgccctgctgtgcgccctgtgctgcggcctgctggcccccgccgccagagccggctacagcgaggagagatgcagctggagaggcagcggcctgacccaggagcccggcagcgtgggccagctggccctggcctgcgccgagggcgccgtggagtggctgtaccccgccggcgccctgagactgaccctgggcggccccgaccccagagccagacccggcatcgcctgcctgagacccgtgagacccttcgccggcgcccaggtgttcgccgagagagccggcggcgccctggagctgctgctggccgagggccccggccccgccggcggcagatgcgtgagatggggccccagagagagaagagccctgttcctgcaggccaccccccaccaggacatcagcagaagagtggccgccttcagattcgagctgagagaggacggcagacccgagctgcccccccaggcccacggcctgggcgtggacggcgcctgcagaccctgcagcgacgccgagctgctgctggccgcctgcaccagcgacttcgtgatccacggcatcatccacggcgtgacccacgacgtggagctgcaggagagcgtgatcaccgtggtggccgccagagtgctgagacagaccccccccctgttccaggccggcagaagcggcgaccagggcctgaccagcatcagaacccccctgagatgcggcgtgcaccccggccccggcaccttcctgttcatgggctggagcagattcggcgaggccagactgggctgcgcccccagattccaggagttcagaagagcctacgaggccgccagagccgcccacctgcacccctgcgaggtggccctgcactag

SEQ ID NO: 2061 - DNA, 708 bp, Artificial Sequence
  Description of Artificial Sequence: Synthetic coding sequence
atggagcaggacgaccccgtggaggccctgaccgagctgagagagagaagactgggcgccctggagctgctgcaggccgccgccggcagcggcctggccgcctacgccgtgtgggccctgctgctgcagcccggcttcagaagagtgcccctgagactgcaggtgccctacgtgggcgccagcgccagacaggtggagcacgtgctgagcctgctgagaggcagacccggcaagaccgtggacctgggcagcggcgacggcagaatcgtgctggccgcccacagatgcggcctgagacccgccgtgggctacgagctgaacccctggctggtggccctggccagactgcacgcctggagagccggctgcgccggcagcgtgtgctacagaagaaaggacctgtggaaggtgagcctgagagactgcagaaacgtgagcgtgttcctggcccccagcgtgctgcccctgctggaggacaagctgagaaccgagctgcccgccggcgccagagtggtgagcggcagattccccctgcccacctggcagcccgtgaccgccgtgggcgagggcctggacagagtgtgggcctacgacgtgcccgagggcggccaggccggcgaggccgccagcagcagaatccccatccaggccgcccccggccccagcagcgcccccatccccggcggcctgatcagccaggccagctag

SEQ ID NO: 2062 - DNA, 2253 bp, Artificial Sequence
  Description of Artificial Sequence: Synthetic coding sequence
atgctgagagccaagaaccagctgttcctgctgagcccccactacctgagacaggtgaaggagagcagcggcagcagactgatccagcagagactgctgcaccagcagcagcccctgcaccccgagtgggccgccctggccaagaagcagctgaagggcaagaaccccgaggacctgatctggcacacccccgagggcatcagcatcaagcccctgtacagcaagagagacaccatggacctgcccgaggagctgcccggcgtgaagcccttcaccagaggcccctaccccaccatgtacaccttcagaccctggaccatcagacagtacgccggcttcagcaccgtggaggagagcaacaagttctacaaggacaacatcaaggccggccagcagggcctgagcgtggccttcgacctggccacccacagaggctacgacagcgacaaccccagagtgagaggcgacgtgggcatggccggcgtggccatcgacaccgtggaggacaccaagatcctgttcgacggcatccccctggagaagatgagcgtgagcatgaccatgaacggcgccgtgatccccgtgctggccaacttcatcgtgaccggcgaggagcagggcgtgcccaaggagaagctgaccggcaccatccagaacgacatcctgaaggagttcatggtgagaaacacctacatcttcccccccgagcccagcatgaagatcatcgccgacatcttcgagtacaccgccaagcacatgcccaagttcaacagcatcagcatcagcggctaccacatgcaggaggccggcgccgacgccatcctggagctggcctacaccctggccgacggcctggagtacagcagaaccggcctgcaggccggcctgaccatcgacgagttcgcccccagactgagcttcttctggggcatcggcatgaacttctacatggagatcgccaagatgagagccggcagaagactgtgggcccacctgatcgagaagatgttccagcccaagaacagcaagagcctgctgctgagagcccactgccagaccagcggctggagcctgaccgagcaggacccctacaacaacatcgtgagaaccgccatcgaggccatggccgccgtgttcggcggcacccagagcctgcacaccaacagcttcgacgaggccctgggcctgcccaccgtgaagagcgccagaatcgccagaaacacccagatcatcatccaggaggagagcggcatccccaaggtggccgacccctggggcggcagctacatgatggagtgcctgaccaacgacgtgtacgacgccgccctgaagctgatcaacgagatcgaggagatgggcggcatggccaaggccgtggccgagggcatccccaagctgagaatcgaggagtgcgccgccagaagacaggccagaatcgacagcggcagcgaggtgatcgtgggcgtgaacaagtaccagctggagaaggaggacgccgtggaggtgctggccatcgacaacaccagcgtgagaaacagacagatcgagaagctgaagaagatcaagagcagcagagaccaggccctggccgagagatgcctggccgccctgaccgagtgcgccgccagcggcgacggcaacatcctggccctggccgtggacgccagcagagccagatgcaccgtgggcgagatcaccgacgccctgaagaaggtgttcggcgagcacaaggccaacgacagaatggtgagcggcgcctacagacaggagttcggcgagagcaaggagatcaccagcgccatcaagagagtgcacaagttcatggagagagagggcagaagacccagactgctggtggccaagatgggccaggacggccacgacagaggcgccaaggtgatcgccaccggcttcgccgacctgggcttcgacgtggacatcggccccctgttccagacccccagagaggtggcccagcaggccgtggacgccgacgtgcacgccgtgggcatcagcaccctggccgccggccacaagaccctggtgcccgagctgatcaaggagctgaacagcctgggcagacccgacatcctggtgatgtgcggcggcgtgatccccccccaggactacgagttcctgttcgaggtgggcgtgagcaacgtgttcggccccggcaccagaatccccaaggccgccgtgcaggtgctggacgacatcgagaagtgcctggagaagaagcagcagagcgtgtag

SEQ ID NO: 2063 - DNA, 594 bp, Artificial Sequence
  Description of Artificial Sequence: Synthetic coding sequence
accagatacctggccagatgcaccgtgggcgagatcaccgacgccctgaagaaggtgttcggcgagcacaaggccaacgacagaatggtgagcggcgcctacagacaggagttcggcgagagcaaggagatcaccagcgccatcaagagagtgcacaagttcatggagagagagggcagaagacccagactgctggtggccaagatgggccaggacggccacgacagaggcgccaaggtgatcgccaccggcttcgccgacctgggcttcgacgtggacatcggccccctgttccagacccccagagaggtggcccagcaggccgtggacgccgacgtgcacgccgtgggcatcagcaccctggccgccggccacaagaccctggtgcccgagctgatcaaggagctgaacagcctgggcagacccgacatcctggtgatgtgcggcggcgtgatccccccccaggactacgagttcctgttcgaggtgggcgtgagcaacgtgttcggccccggcaccagaatccccaaggccgccgtgcaggtgctggacgacatcgagaagtgcctggagaagaagcagcagagcgtgtag

SEQ ID NO: 2064 - DNA, 2685 bp, Artificial Sequence
  Description of Artificial Sequence: Synthetic coding sequence
atgatcctgctggccgtgctgttcctgtgcttcatcagcagctacagcgccagcgtgaagggccacaccaccggcctgagcctgaacaacgacagactgtacaagctgacctacagcaccgaggtgctgctggacagaggcaagggcaagctgcaggacagcgtgggctacagaatcagcagcaacgtggacgtggccctgctgtggagaaaccccgacggcgacgacgaccagctgatccagatcaccatgaaggacgtgaacgtggagaacgtgaaccagcagagaggcgagaagagcatcttcaagggcaagagccccagcaagatcatgggcaaggagaacctggaggccctgcagagacccaccctgctgcacctgatccacggcaaggtgaaggagttctacagctaccagaacgaggccgtggccatcgagaacatcaagagaggcctggccagcctgttccagacccagctgagcagcggcaccaccaacgaggtggacatcagcggcaactgcaaggtgacctaccaggcccaccaggacaaggtgatcaagatcaaggccctggacagctgcaagatcgccagaagcggcttcaccacccccaaccaggtgctgggcgtgagcagcaaggccaccagcgtgaccacctacaagatcgaggacagcttcgtgatcgccgtgctggccgaggagacccacaacttcggcctgaacttcctgcagaccatcaagggcaagatcgtgagcaagcagaagctggagctgaagaccaccgaggccggccccagactgatgagcggcaagcaggccgccgccatcatcaaggccgtggacagcaagtacaccgccatccccatcgtgggccaggtgttccagagccactgcaagggctgccccagcctgagcgagctgtggagaagcaccagaaagtacctgcagcccgacaacctgagcaaggccgaggccgtgagaaacttcctggccttcatccagcacctgagaaccgccaagaaggaggagatcctgcagatcctgaagatggagaacaaggaggtgctgccccagctggtggacgccgtgaccagcgcccagaccagcgacagcctggaggccatcctggacttcctggacttcaagagcgacagcagcatcatcctgcaggagagattcctgtacgcctgcggcttcgccagccaccccaacgaggagctgctgagagccctgatcagcaagttcaagggcagcatcggcagcagcgacatcagagagaccgtgatgatcatcaccggcaccctggtgagaaagctgtgccagaacgagggctgcaagctgaaggccgtggtggaggccaagaagctgatcctgggcggcctggagaaggccgagaagaaggaggacaccagaatgtacctgctggccctgaagaacgccctgctgcccgagggcatccccagcctgctgaagtacgccgaggccggcgagggccccatcagccacctggccaccaccgccctgcagagatacgacctgcccttcatcaccgacgaggtgaagaagaccctgaacagaatctaccaccagaacagaaaggtgcacgagaagaccgtgagaaccgccgccgccgccatcatcctgaacaacaaccccagctacatggacgtgaagaacatcctgctgagcatcggcgagctgccccaggagatgaacaagtacatgctggccatcgtgcaggacatcctgagattcgagatgcccgccagcaagatcgtgagaagagtgctgaaggagatggtggcccacaactacgacagattcagcagaagcggcagcagcagcgcctacaccggctacatcgagagaagccccagaagcgccagcacctacagcctggacatcctgtacagcggcagcggcatcctgagaagaagcaacctgaacatcttccagtacatcggcaaggccggcctgcacggcagccaggtggtgatcgaggcccagggcctggaggccctgatcgccgccacccccgacgagggcgaggagaacctggacagctacgccggcatgagcgccatcctgttcgacgtgcagctgagacccgtgaccttcttcaacggctacagcgacctgatgagcaagatgctgagcgccagcggcgaccccatcagcgtggtgaagggcctgatcctgctgatcgaccacagccaggagctgcagctgcagagcggcctgaaggccaacatcgaggtgcagggcggcctggccatcgacatcagcggcgccatggagttcagcctgtggtacagagagagcaagaccagagtgaagaacagagtgaccgtggtgatcaccaccgacatcaccgtggacagcagcttcgtgaaggccggcctggagaccagcaccgagaccgaggccggcctggagttcatcagcaccgtgcagttcagccagtaccccttcctggtgtgcatgcagatggacaaggacgaggcccccttcagacagttcgagaagaagtacgagagactgagcaccggcagaggctacgtgagccagaagagaaaggagagcgtgctggccggctgcgagttccccctgcaccaggagaacagcgagatgtgcaaggtggtgttcgccccccagcccgacagcaccagcagcggctggttctag

SEQ ID NO: 2065 - DNA, 2685 bp, Artificial Sequence; identical to SEQ ID NO: 2064
  Description of Artificial Sequence: Synthetic coding sequence

SEQ ID NO: 2066 - DNA, 537 bp, Artificial Sequence
  Description of Artificial Sequence: Synthetic coding sequence
atggccagagcccccctgagacccgagaacaccatcgtgagaggcagcgccaaccagtgccaggacacctacagagccgaggagctgaccggccacaccaccggcctgagcctgaacaacgacagactgtacaagctgacctacagcaccgaggtgctgctggacagaggcaagggcaagctgcaggacagcgtgggctacagaatcagcagcaacgtggacgtggccctgctgtggagaaaccccgacggcgacgacgaccagctgatccagatcaccatgaaggacgtgaacgtggagaacgtgaaccagcagagaggcgagaagagcatcttcaagggcaagagccccagcaagatcatgggcaaggagaacctggaggccctgcagagacccaccctgctgcacctgatccacggcaaggtgaaggagttctacagctaccagaacgaggccgtggccatcgagaacatcaagagaggcctggccagcctgttccagacccagctgagcagcggcaccaccaacgaggtgtag

SEQ ID NO: 2067 - DNA, 1551 bp, Artificial Sequence
  Description of Artificial Sequence: Synthetic coding sequence
atgatcctgctggccgtgctgttcctgtgcttcatcagcagctacagcgccagcgtgaagggccacaccaccggcctgagcctgaacaacgacagactgtacaagctgacctacagcaccgaggtgctgctggacagaggcaagggcaagctgcaggacagcgtgggctacagaatcagcagcaacgtggacgtggccctgctgtggagaaaccccgacggcgacgacgaccagctgatccagatcaccatgaaggacgtgaacgtggagaacgtgaaccagcagagaggcgagaagagcatcttcaagggcaagagccccagcaagatcatgggcaaggagaacctggaggccctgcagagacccaccctgctgcacctgatccacggcaaggtgaaggagttctacagctaccagaacgaggccgtggccatcgagaacatcaagagaggcctggccagcctgttccagacccagctgagcagcggcaccaccaacgaggtggacatcagcggcaactgcaaggtgacctaccaggcccaccaggacaaggtgatcaagatcaaggccctggacagctgcaagatcgccagaagcggcttcaccacccccaaccaggtgctgggcgtgagcagcaaggccaccagcgtgaccacctacaagatcgaggacagcttcgtgatcgccgtgctggccgaggagacccacaacttcggcctgaacttcctgcagaccatcaagggcaagatcgtgagcaagcagaagctggagctgaagaccaccgaggccggccccagactgatgagcggcaagcaggccgccgccatcatcaaggccgtggacagcaagtacaccgccatccccatcgtgggccaggtgttccagagccactgcaagggctgccccagcctgagcgagctgtggagaagcaccagaaagtacctgcagcccgacaacctgagcaaggccgaggccgtgagaaacttcctggccttcatccagcacctgagaaccgccaagaaggaggagatcctgcagatcctgaagatggagaacaaggaggtgctgccccagctggtggacgccgtgaccagcgcccagaccagcgacagcctggaggccatcctggacttcctggacttcaagagcgacagcagcatcatcctgcaggagagattcctgtacgcctgcggcttcgccagccaccccaacgaggagctgctgagagccctgatcagcaagttcaagggcagcatcggcagcagcgacatcagagagaccgtgatgatcatcaccggcaccctggtgagaaagctgtgccagaacgagggctgcaagctgaaggccgtggtggaggccaagaagctgatcctgggcggcctggagaaggccgagaagaaggaggacaccagaatgtacctgctggccctgaagaacgccctgctgcccgagggcatccccagcctgctgaagtacgccgaggccggcgagggccccatcagccacctggccaccaccgccctgcagagatacgacctgttccacaactag

SEQ ID NO: 2068 - DNA, 3771 bp, Artificial Sequence
  Description of Artificial Sequence: Synthetic coding sequence
atgctgttcaagctgctgcagagacagacctacacctgcctgagccacagatacggcctgtacgtgtgcttcctgggcgtggtggtgaccatcgtgagcgccttccagttcggcgaggtggtgctggagtggagcagagaccagtaccacgtgctgttcgacagctacagagacaacatcgccggcaagagcttccagaacagactgtgcctgcccatgcccatcgacgtggtgtacacctgggtgaacggcaccgacctggagctgctgaaggagctgcagcaggtgagagagcagatggaggaggagcagaaggccatgagagagatcctgggcaagaacaccaccgagcccaccaagaagagcgagaagcagctggagtgcctgctgacccactgcatcaaggtgcccatgctggtgctggaccccgccctgcccgccaacatcaccctgaaggacctgcccagcctgtaccccagcttccacagcgccagcgacatcttcaacgtggccaagcccaagaaccccagcaccaacgtgagcgtggtggtgttcgacagcaccaaggacgtggaggacgcccacagcggcctgctgaagggcaacagcagacagaccgtgtggagaggctacctgaccaccgacaaggaggtgcccggcctggtgctgatgcaggacctggccttcctgagcggcttcccccccaccttcaaggagaccaaccagctgaagaccaagctgcccgagaacctgagcagcaaggtgaagctgctgcagctgtacagcgaggccagcgtggccctgctgaagctgaacaaccccaaggacttccaggagctgaacaagcagaccaagaagaacatgaccatcgacggcaaggagctgaccatcagccccgcctacctgctgtgggacctgagcgccatcagccagagcaagcaggacgaggacatcagcgccagcagattcgaggacaacgaggagctgagatacagcctgagaagcatcgagagacacgccccctgggtgagaaacatcttcatcgtgaccaacggccagatccccagctggctgaacctggacaaccccagagtgaccatcgtgacccaccaggacgtgttcagaaacctgagccacctgcccaccttcagcagccccgccatcgagagccacatccacagaatcgagggcctgagccagaagttcatctacctgaacgacgacgtgatgttcggcaaggacgtgtggcccgacgacttctacagccacagcaagggccagaaggtgtacctgacctggcccgtgcccaactgcgccgagggctgccccggcagctggatcaaggacggctactgcgacaaggcctgcaacaacagcgcctgcgactgggacggcggcgactgcagcggcaacagcggcggcagcagatacatcgccggcggcggcggcaccggcagcatcggcgtgggccagccctggcagttcggcggcggcatcaacagcgtgagctactgcaaccagggctgcgccaacagctggctggccgacaagttctgcgaccaggcctgcaacgtgctgagctgcggcttcgacgccggcgactgcggccaggaccacttccacgagctgtacaaggtgatcctgctgcccaaccagacccactacatcatccccaagggcgagtgcctgccctacttcagcttcgccgaggtggccaagagaggcgtggagggcgcctacagcgacaaccccatcatcagacacgccagcatcgccaacaagtggaagaccatccacctgatcatgcacagcggcatgaacgccaccaccatccacttcaacctgaccttccagaacaccaacgacgaggagttcaagatgcagatcaccgtggaggtggacaccagagagggccccaagctgaacagcaccgcccagaagggctacgagaacctggtgagccccatcaccctgctgcccgaggccgagatcctgttcgaggacatccccaaggagaagagattccccaagttcaagagacacgacgtgaacagcaccagaagagcccaggaggaggtgaagatccccctggtgaacatcagcctgctgcccaaggacgcccagctgagcctgaacaccctggacctgcagctggagcacggcgacatcaccctgaagggctacaacctgagcaagagcgccctgctgagaagcttcctgatgaacagccagcacgccaagatcaagaaccaggccatcatcaccgacgagaccaacgacagcctggtggccccccaggagaagcaggtgcacaagagcatcctgcccaacagcctgggcgtgagcgagagactgcagagactgaccttccccgccgtgagcgtgaaggtgaacggccacgaccagggccagaacccccccctggacctggagaccaccgccagattcagagtggagacccacacccagaagaccatcggcggcaacgtgaccaaggagaagccccccagcctgatcgtgcccctggagagccagatgaccaaggagaagaagatcaccggcaaggagaaggagaacagcagaatggaggagaacgccgagaaccacatcggcgtgaccgaggtgctgctgggcagaaagctgcagcactacaccgacagctacctgggcttcctgccctgggagaagaagaagtacttccaggacctgctggacgaggaggagagcctgaagacccagctggcctacttcaccgacagcaagaacaccggcagacagctgaaggacaccttcgccgacagcctgagatacgtgaacaagatcctgaacagcaagttcggcttcaccagcagaaaggtgcccgcccacatgccccacatgatcgacagaatcgtgatgcaggagctgcaggacatgttccccgaggagttcgacaagaccagcttccacaaggtgagacacagcgaggacatgcagttcgccttcagctacttctactacctgatgagcgccgtgcagcccctgaacatcagccaggtgttcgacgaggtggacaccgaccagagcggcgtgctgagcgacagagagatcagaaccctggccaccagaatccacgagctgcccctgagcctgcaggacctgaccggcctggagcacatgctgatcaactgcagcaagatgctgcccgccgacatcacccagctgaacaacatcccccccacccaggagagctactacgaccccaacctgccccccgtgaccaagagcctggtgaccaactgcaagcccgtgaccgacaagatccacaaggcctacaaggacaagaacaagtacagattcgagatcatgggcgaggaggagatcgccttcaagatgatcagaaccaacgtgagccacgtggtgggccagctggacgacatcagaaagaaccccagaaagttcgtgtgcctgaacgacaacatcgaccacaaccacaaggacgcccagaccgtgaaggccgtgctgagagacttctacgagagcatgttccccatccccagccagttcgagctgcccagagagtacagaaacagattcctgcacatgcacgagctgcaggagtggagagcctacagagacaagctgaagttctggacccactgcgtgctggccaccctgatcatgttcaccatcttcagcttcttcgccgagcagctgatcgccctgaagagaaagatcttccccagaagaagaatccacaaggaggccagccccaacagaatcagagtgtag

SEQ ID NO: 2069 - DNA, 1473 bp, Artificial Sequence
  Description of Artificial Sequence: Synthetic coding sequence
atgctgttcaagctgctgcagagacagacctacacctgcctgagccacagatacggcctgtacgtgtgcttcctgggcgtggtggtgaccatcgtgagcgccttccagttcggcgaggtggtgctggagtggagcagagaccagtaccacgtgctgttcgacagctacagagacaacatcgccggcaagagcttccagaacagactgtgcctgcccatgcccatcgacgtggtgtacacctgggtgaacggcaccgacctggagctgctgaaggagctgcagcaggtgagagagcagatggaggaggagcagaaggccatgagagagatcctgggcaagaacaccaccgagcccaccaagaagagcgagaagcagctggagtgcctgctgacccactgcatcaaggtgcccatgctggtgctggaccccgccctgcccgccaacatcaccctgaaggacctgcccagcctgtaccccagcttccacagcgccagcgacatcttcaacgtggccaagcccaagaaccccagcaccaacgtgagcgtggtggtgttcgacagcaccaaggacgtggaggacgcccacagcggcctgctgaagggcaacagcagacagaccgtgtggagaggctacctgaccaccgacaaggaggtgcccggcctggtgctgatgcaggacctggccttcctgagcggcttcccccccaccttcaaggagaccaaccagctgaagaccaagctgcccgagaacctgagcagcaaggtgaagctgctgcagctgtacagcgaggccagcgtggccctgctgaagctgaacaaccccaaggacttccaggagctgaacaagcagaccaagaagaacatgaccatcgacggcaaggagctgaccatcagccccgcctacctgctgtgggacctgagcgccatcagccagagcaagcaggacgaggacatcagcgccagcagattcgaggacaacgaggagctgagatacagcctgagaagcatcgagagacacgccccctgggtgagaaacatcttcatcgtgaccaacggccagatccccagctggctgaacctggacaaccccagagtgaccatcgtgacccaccaggacgtgttcagaaacctgagccacctgcccaccttcagcagccccgccatcgagagccacatccacagaatcgagggcctgagccagaagttcatctacctgaacgacgacgtgatgttcggcaaggacgtgtggcccgacgacttctacagccacagcaagggccagaaggtgtacctgacctggcccgtgcccaactgcgccgagggctgccccggcagctggatcaaggacggctactgcgacaaggcctgcaacaacagcgcctgcgactgggacggcggcgactgcagcggcaaggacgtgctgaactgcaacagcttcatcttcatggagtacttcctgctgaaccactactag

SEQ ID NO: 2070 - DNA, 1605 bp, Artificial Sequence
  Description of Artificial Sequence: Synthetic coding sequence
atggccaccgccctgatggccgtggtgctgagagccgccgccgtggcccccagactgagaggcagaggcggcaccggcggcgccagaagactgagctgcggcgccagaagaagagccgccagaggcaccagccccggcagaagactgagcaccgcctggagccagccccagcccccccccgaggagtacgccggcgccgacgacgtgagccagagccccgtggccgaggagcccagctgggtgcccagccccagaccccccgtgccccacgagagccccgagccccccagcggcagaagcctggtgcagagagacatccaggccttcctgaaccagtgcggcgccagccccggcgaggccagacactggctgacccagttccagacctgccaccacagcgccgacaagcccttcgccgtgatcgaggtggacgaggaggtgctgaagtgccagcagggcgtgagcagcctggccttcgccctggccttcctgcagagaatggacatgaagcccctggtggtgctgggcctgcccgcccccaccgcccccagcggctgcctgagcttctgggaggccaaggcccagctggccaagagctgcaaggtgctggtggacgccctgagacacaacgccgccgccgccgtgcccttcttcggcggcggcagcgtgctgagagccgccgagcccgccccccacgccagctacggcggcatcgtgagcgtggagaccgacctgctgcagtggtgcctggagagcggcagcatccccatcctgtgccccatcggcgagaccgccgccagaagaagcgtgctgctggacagcctggaggtgaccgccagcctggccaaggccctgagacccaccaagatcatcttcctgaacaacaccggcggcctgagagacagcagccacaaggtgctgagcaacgtgaacctgcccgccgacctggacctggtgtgcaacgccgagtgggtgagcaccaaggagagacagcagatgagactgatcgtggacgtgctgagcagactgccccaccacagcagcgccgtgatcaccgccgccagcaccctgctgaccgagctgttcagcaacaagggcagcggcaccctgttcaagaacgccgagagaatgctgagagtgagaagcctggacaagctggaccagggcagactggtggacctggtgaacgccagcttcggcaagaagctgagagacgactacctggccagcctgagacccagactgcacagcatctacgtgagcgagggctacaacgccgccgccatcctgaccatggagcccgtgctgggcggcaccccctacctggacaagttcgtggtgagcagcagcagacagggccagggcagcggccagatgctgtgggagtgcctgagaagagacctgcagaccctgttctggagaagcagagtgaccaaccccatcaacccctggtacttcaagcacagcgacggcagcttcagcaacaagcagtggatcttcttctggttcggcctggccgacatcagagacagctacgagctggtgaaccacgccaagggcctgcccgacagcttccacaagcccgccagcgaccccggcagctag

SEQ ID NO: 2071 - DNA, 1107 bp, Artificial Sequence
  Description of Artificial Sequence: Synthetic coding sequence
atggacatgaagcccctggtggtgctgggcctgcccgcccccaccgcccccagcggctgcctgagcttctgggaggccaaggcccagctggccaagagctgcaaggtgctggtggacgccctgagacacaacgccgccgccgccgtgcccttcttcggcggcggcagcgtgctgagagccgccgagcccgccccccacgccagctacggcggcatcgtgagcgtggagaccgacctgctgcagtggtgcctggagagcggcagcatccccatcctgtgccccatcggcgagaccgccgccagaagaagcgtgctgctggacagcctggaggtgaccgccagcctggccaaggccctgagacccaccaagatcatcttcctgaacaacaccggcggcctgagagacagcagccacaaggtgctgagcaacgtgaacctgcccgccgacctggacctggtgtgcaacgccgagtgggtgagcaccaaggagagacagcagatgagactgatcgtggacgtgctgagcagactgccccaccacagcagcgccgtgatcaccgccgccagcaccctgctgaccgagctgttcagcaacaagggcagcggcaccctgttcaagaacgccgagagaatgctgagagtgagaagcctggacaagctggaccagggcagactggtggacctggtgaacgccagcttcggcaagaagctgagagacgactacctggccagcctgagacccagactgcacagcatctacgtgagcgagggctacaacgccgccgccatcctgaccatggagcccgtgctgggcggcaccccctacctggacaagttcgtggtgagcagcagcagacagggccagggcagcggccagatgctgtgggagtgcctgagaagagacctgcagaccctgttctggagaagcagagtgaccaaccccatcaacccctggtacttcaagcacagcgacggcagcttcagcaacaagcagtggatcttcttctggttcggcctggccgacatcagagacagctacgagctggtgaaccacgccaagggcctgcccgacagcttccacaagcccgccagcgaccccggcagctag

SEQ ID NO: 2072 - DNA, 1188 bp, Artificial Sequence
  Description of Artificial Sequence: Synthetic coding sequence
atgcccggcagaagctgcgtggccctggtgctgctggccgccgccgtgagctgcgccgtggcccagcacgcccccccctggaccgaggactgcagaaagagcacctacccccccagcggccccacctacagaggcgccgtgccctggtacaccatcaacctggacctgcccccctacaagagatggcacgagctgatgctggacaaggcccccgtgctgaaggtgatcgtgaacagcctgaagaacatgatcaacaccttcgtgcccagcggcaagatcatgcaggtggtggacgagaagctgcccggcctgctgggcaacttccccggccccttcgaggaggagatgaagggcatcgccgccgtgaccgacatccccctgggcgagatcatcagcttcaacatcttctacgagctgttcaccatctgcaccagcatcgtggccgaggacaagaagggccacctgatccacggcagaaacatggacttcggcgtgttcctgggctggaacatcaacaacgacacctgggtgatcaccgagcagctgaagcccctgaccgtgaacctggacttccagagaaacaacaagaccgtgttcaaggccagcagcttcgccggctacgtgggcatgctgaccggcttcaagcccggcctgttcagcctgaccctgaacgagagattcagcatcaacggcggctacctgggcatcctggagtggatcctgggcaagaaggacgtgatgtggatcggcttcctgaccagaaccgtgctggagaacagcaccagctacgaggaggccaagaacctgctgaccaagaccaagatcctggcccccgcctacttcatcctgggcggcaaccagagcggcgagggctgcgtgatcaccagagacagaaaggagagcctggacgtgtacgagctggacgccaagcagggcagatggtacgtggtgcagaccaactacgacagatggaagcaccccttcttcctggacgacagaagaacccccgccaagatgtgcctgaacagaaccagccaggagaacatcagcttcgagaccatgtacgacgtgctgagcaccaagcccgtgctgaacaagctgaccgtgtacaccaccctgatcgacgtgaccaagggccagttcgagacctacctgagagactgccccgacccctgcatcggctggtag

SEQ ID NO: 2073 - DNA, 1170 bp, Artificial Sequence
  Description of Artificial Sequence: Synthetic coding sequence
atgaactgctgcatcggcctgggcgagaaggccagaggcagccacagagccagctaccccagcctgagcgccctgttcaccgaggccagcatcctgggcttcggcagcttcgccgtgaaggcccagtggaccgaggactgcagaaagagcacctacccccccagcggccccaccgtgttccccgccgtgatcagatacagaggcgccgtgccctggtacaccatcaacctggacctgcccccctacaagagatggcacgagctgatgctggacaaggcccccgtgcccggcctgctgggcaacttccccggccccttcgaggaggagatgaagggcatcgccgccgtgaccgacatccccctgggcgagatcatcagcttcaacatcttctacgagctgttcaccatctgcaccagcatcgtggccgaggacaagaagggccacctgatccacggcagaaacatggacttcggcgtgttcctgggctggaacatcaacaacgacacctgggtgatcaccgagcagctgaagcccctgaccgtgaacctggacttccagagaaacaacaagaccgtgttcaaggccagcagcttcgccggctacgtgggcatgctgaccggcttcaagcccggcctgttcagcctgaccctgaacgagagattcagcatcaacggcggctacctgggcatcctggagtggatcctgggcaagaaggacgtgatgtggatcggcttcctgaccagaaccgtgctggagaacagcaccagctacgaggaggccaagaacctgctgaccaagaccaagatcctggcccccgcctacttcatcctgggcggcaaccagagcggcgagggctgcgtgatcaccagagacagaaaggagagcctggacgtgtacgagctggacgccaagcagggcagatggtacgtggtgcagaccaactacgacagatggaagcaccccttcttcctggacgacagaagaacccccgccaagatgtgcctgaacagaaccagccaggagaacatcagcttcgagaccatgtacgacgtgctgagcaccaagcccgtgctgaacaagctgaccgtgtacaccaccctgatcgacgtgaccaagggccagttcgagacctacctgagagactgccccgacccctgcatcggctggtag

SEQ ID NO: 2074 - DNA, 1236 bp, Artificial Sequence
  Description of Artificial Sequence: Synthetic coding sequence
atgaactgctgcatcggcctgggcgagaaggccagaggcagccacagagccagctaccccagcctgagcgccctgttcaccgaggccagcatcctgggcttcggcagcttcgccgtgaaggcccagtggaccgaggactgcagaaagagcacctacccccccagcggccccacctacagaggcgccgtgccctggtacaccatcaacctggacctgcccccctacaagagatggcacgagctgatgctggacaaggcccccgtgctgaaggtgatcgtgaacagcctgaagaacatgatcaacaccttcgtgcccagcggcaagatcatgcaggtggtggacgagaagctgcccggcctgctgggcaacttccccggccccttcgaggaggagatgaagggcatcgccgccgtgaccgacatccccctgggcgagatcatcagcttcaacatcttctacgagctgttcaccatctgcaccagcatcgtggccgaggacaagaagggccacctgatccacggcagaaacatggacttcggcgtgttcctgggctggaacatcaacaacgacacctgggtgatcaccgagcagctgaagcccctgaccgtgaacctggacttccagagaaacaacaagaccgtgttcaaggccagcagcttcgccggctacgtgggcatgctgaccggcttcaagcccggcctgttcagcctgaccctgaacgagagattcagcatcaacggcggctacctgggcatcctggagtggatcctgggcaagaaggacgtgatgtggatcggcttcctgaccagaaccgtgctggagaacagcaccagctacgaggaggccaagaacctgctgaccaagaccaagatcctggcccccgcctacttcatcctgggcggcaaccagagcggcgagggctgcgtgatcaccagagacagaaaggagagcctggacgtgtacgagctggacgccaagcagggcagatggtacgtggtgcagaccaactacgacagatggaagcaccccttcttcctggacgacagaagaacccccgccaagatgtgcctgaacagaaccagccaggagaacatcagcttcgagaccatgtacgacgtgctgagcaccaagcccgtgctgaacaagctgaccgtgtacaccaccctgatcgacgtgaccaagggccagttcgagacctacctgagagactgccccgacccctgcatcggctggtag

SEQ ID NO: 2075 - DNA, 918 bp, Artificial Sequence
  Description of Artificial Sequence: Synthetic coding sequence
atgctggacaaggcccccgtgctgaaggtgatcgtgaacagcctgaagaacatgatcaacaccttcgtgcccagcggcaagatcatgcaggtggtggacgagaagctgcccggcctgctgggcaacttccccggccccttcgaggaggagatgaagggcatcgccgccgtgaccgacatccccctgggccacctgatccacggcagaaacatggacttcggcgtgttcctgggctggaacatcaacaacgacacctgggtgatcaccgagcagctgaagcccctgaccgtgaacctggacttccagagaaacaacaagaccgtgttcaaggccagcagcttcgccggctacgtgggcatgctgaccggcttcaagcccggcctgttcagcctgaccctgaacgagagattcagcatcaacggcggctacctgggcatcctggagtggatcctgggcaagaaggacgtgatgtggatcggcttcctgaccagaaccgtgctggagaacagcaccagctacgaggaggccaagaacctgctgaccaagaccaagatcctggcccccgcctacttcatcctgggcggcaaccagagcggcgagggctgcgtgatcaccagagacagaaaggagagcctggacgtgtacgagctggacgccaagcagggcagatggtacgtggtgcagaccaactacgacagatggaagcaccccttcttcctggacgacagaagaacccccgccaagatgtgcctgaacagaaccagccaggagaacatcagcttcgagaccatgtacgacgtgctgagcaccaagcccgtgctgaacaagctgaccgtgtacaccaccctgatcgacgtgaccaagggccagttcgagacctacctgagagactgccccgacccctgcatcggctggtag

SEQ ID NO: 2076 - DNA, 1113 bp, Artificial Sequence
  Description of Artificial Sequence: Synthetic coding sequence
atgcccggcagaagctgcgtggccctggtgctgctggccgccgccgtgagctgcgccgtggcccagcacgcccccccctggaccgaggactgcagaaagagcacctacccccccagcggccccacctacagaggcgccgtgccctggtacaccatcaacctggacctgcccccctacaagagatggcacgagctgatgctggacaaggcccccgtgctgaaggtgatcgtgaacagcctgaagaacatgatcaacaccttcgtgcccagcggcaagatcatgcaggtggtggacgagaagctgcccggcctgctgggcaacttccccggccccttcgaggaggagatgaagggcatcgccgccgtgaccgacatccccctgggccacctgatccacggcagaaacatggacttcggcgtgttcctgggctggaacatcaacaacgacacctgggtgatcaccgagcagctgaagcccctgaccgtgaacctggacttccagagaaacaacaagaccgtgttcaaggccagcagcttcgccggctacgtgggcatgctgaccggcttcaagcccggcctgttcagcctgaccctgaacgagagattcagcatcaacggcggctacctgggcatcctggagtggatcctgggcaagaaggacgtgatgtggatcggcttcctgaccagaaccgtgctggagaacagcaccagctacgaggaggccaagaacctgctgaccaagaccaagatcctggcccccgcctacttcatcctgggcggcaaccagagcggcgagggctgcgtgatcaccagagacagaaaggagagcctggacgtgtacgagctggacgccaagcagggcagatggtacgtggtgcagaccaactacgacagatggaagcaccccttcttcctggacgacagaagaacccccgccaagatgtgcctgaacagaaccagccaggagaacatcagcttcgagaccatgtacgacgtgctgagcaccaagcccgtgctgaacaagctgaccgtgtacaccaccctgatcgacgtgaccaagggccagttcgagacctacctgagagactgccccgacccctgcatcggctggtag

SEQ ID NO: 2077 - DNA, 405 bp, Artificial Sequence
  Description of Artificial Sequence: Synthetic coding sequence
atggacccccagaccgcccccagcagagccctgctgctgctgctgttcctgcacctggccttcctgggcggcagaagccaccccctgggcagccccggcagcgccagcgacctggagaccagcggcctgcaggagcagagaaaccacctgcagggcaagctgagcgagctgcaggtggagcagaccagcctggagcccctgcaggagagccccagacccaccggcgtgtggaagagcagagaggtggccaccgagggcatcagaggccacagaaagatggtgctgtacaccctgagagcccccagaagccccaagatggtgcagggcagcggctgcttcggcagaaagatggacagaatcagcagcagcagcggcctgggctgcaaggtgctgagaagacactag

SEQ ID NO: 2078 - DNA, 726 bp, Artificial Sequence
  Description of Artificial Sequence: Synthetic coding sequence
atgagcatgctgttctacaccctgatcaccgccttcctgatcggcatccaggccgagccccacagcgagagcaacgtgcccgccggccacaccatcccccaggcccactggaccaagctgcagcacagcctggacaccgccctgagaagagccagaagcgcccccgccgccgccatcgccgccagagtggccggccagaccagaaacatcaccgtggaccccagactgttcaagaagagaagactgagaagccccagagtgctgttcagcacccagccccccagagaggccgccgacacccaggacctggacttcgaggtgggcggcgccgcccccttcaacagaacccacagaagcaagagaagcagcagccaccccatcttccacagaggcgagttcagcgtgtgcgacagcgtgagcgtgtgggtgggcgacaagaccaccgccaccgacatcaagggcaaggaggtgatggtgctgggcgaggtgaacatcaacaacagcgtgttcaagcagtacttcttcgagaccaagtgcagagaccccaaccccgtggacagcggctgcagaggcatcgacagcaagcactggaacagctactgcaccaccacccacaccttcgtgaaggccctgaccatggacggcaagcaggccgcctggagattcatcagaatcgacaccgcctgcgtgtgcgtgctgagcagaaaggccgtgagaagagcctag

SEQ ID NO: 2079 - DNA, 1923 bp, Artificial Sequence
  Description of Artificial Sequence: Synthetic coding sequence
atgagcgagagaaaggagggcagaggcaagggcaagggcaagaagaaggagagaggcagcggcaagaagcccgagagcgccgccggcagccagagccccgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgagatcatcaccggcatgcccgccagcaccgagggcgcctacgtgagcagcgagagccccatcagaatcagcgtgagcaccgagggcgccaacaccagcagcagcaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccagcccggcttcaccggcgccagatgcaccgagaacgtgcccatgaaggtgcagaaccaggagaaggccgaggagctgtaccagaagagagtgctgaccatcaccggcatctgcatcgccctgctggtggtgggcatcatgtgcgtggtggcctactgcaagaccaagaagcagagaaagaagctgcacgacagactgagacagagcctgagaagcgagagaaacaacatgatgaacatcgccaacggcccccaccaccccaaccccccccccgagaacgtgcagctggtgaaccagtacgtgagcaagaacgtgatcagcagcgagcacatcgtggagagagaggccgagaccagcttcagcaccagccactacaccagcaccgcccaccacagcaccaccgtgacccagacccccagccacagctggagcaacggccacaccgagagcatcctgagcgagagccacagcgtgatcgtgatgagcagcgtggagaacagcagacacagcagccccaccggcggccccagaggcagactgaacggcaccggcggccccagagagtgcaacagcttcctgagacacgccagagagacccccgacagctacagagacagcccccacagcgagagatacgtgagcgccatgaccacccccgccagaatgagccccgtggacttccacacccccagcagccccaagagcccccccagcgagatgagcccccccgtgagcagcatgaccgtgagcatgcccagcatggccgtgagccccttcatggaggaggagagacccctgctgctggtgaccccccccagactgagagagaagaagttcgaccaccacccccagcagttcagcagcttccaccacaaccccgcccacgacagcaacagcctgcccgccagccccctgagaatcgtggaggacgaggagtacgagaccacccaggagtacgagcccgcccaggagcccgtgaagaagctggccaacagcagaagagccaagagaaccaagcccaacggccacatcgccaacagactggaggtggacagcaacaccagcagccagagcagcaacagcgagagcgagaccgaggacgagagagtgggcgaggacacccccttcctgggcatccagaaccccctggccgccagcctggaggccacccccgccttcagactggccgacagcagaaccaaccccgccggcagattcagcacccaggaggagatccaggccagactgagcagcgtgatcgccaaccaggaccccatcgccgtgtag

SEQ ID NO: 2080 - DNA, 1914 bp, Artificial Sequence
  Description of Artificial Sequence: Synthetic coding sequence
atgagcgagagaaaggagggcagaggcaagggcaagggcaagaagaaggagagaggcagcggcaagaagcccgagagcgccgccggcagccagagccccgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgagatcatcaccggcatgcccgccagcaccgagggcgcctacgtgagcagcgagagccccatcagaatcagcgtgagcaccgagggcgccaacaccagcagcagcaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccccaacgagttcaccggcgacagatgccagaactacgtgatggccagcttctacaaggccgaggagctgtaccagaagagagtgctgaccatcaccggcatctgcatcgccctgctggtggtgggcatcatgtgcgtggtggcctactgcaagaccaagaagcagagaaagaagctgcacgacagactgagacagagcctgagaagcgagagaaacaacatgatgaacatcgccaacggcccccaccaccccaaccccccccccgagaacgtgcagctggtgaaccagtacgtgagcaagaacgtgatcagcagcgagcacatcgtggagagagaggccgagaccagcttcagcaccagccactacaccagcaccgcccaccacagcaccaccgtgacccagacccccagccacagctggagcaacggccacaccgagagcatcctgagcgagagccacagcgtgatcgtgatgagcagcgtggagaacagcagacacagcagccccaccggcggccccagaggcagactgaacggcaccggcggccccagagagtgcaacagcttcctgagacacgccagagagacccccgacagctacagagacagcccccacagcgagagatacgtgagcgccatgaccacccccgccagaatgagccccgtggacttccacacccccagcagccccaagagcccccccagcgagatgagcccccccgtgagcagcatgaccgtgagcatgcccagcatggccgtgagccccttcatggaggaggagagacccctgctgctggtgaccccccccagactgagagagaagaagttcgaccaccacccccagcagttcagcagcttccaccacaaccccgcccacgacagcaacagcctgcccgccagccccctgagaatcgtggaggacgaggagtacgagaccacccaggagtacgagcccgcccaggagcccgtgaagaagctggccaacagcagaagagccaagagaaccaagcccaacggccacatcgccaacagactggaggtggacagcaacaccagcagccagagcagcaacagcgagagcgagaccgaggacgagagagtgggcgaggacacccccttcctgggcatccagaaccccctggccgccagcctggaggccacccccgccttcagactggccgacagcagaaccaaccccgccggcagattcagcacccaggaggagatccaggccagactgagcagcgtgatcgccaaccaggaccccatcgccgtgtag

SEQ ID NO: 2081 - DNA, 1836 bp, Artificial Sequence
  Description of Artificial Sequence: Synthetic coding sequence
atgagcgagagaaaggagggcagaggcaagggcaagggcaagaagaaggagagaggcagcggcaagaagcccgagagcgccgccggcagccagagccccgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgccaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccccaacgagttcaccggcgacagatgccagaactacgtgatggccagcttctacaagcacctgggcatcgagttcatggaggccgaggagctgtaccagaagagagtgctgaccatcaccggcatctgcatcgccctgctggtggtgggcatcatgtgcgtggtggcctactgcaagaccaagaagcagagaaagaagctgcacgacagactgagacagagcctgagaagcgagagaaacaacatgatgaacatcgccaacggcccccaccaccccaaccccccccccgagaacgtgcagctggtgaaccagtacgtgagcaagaacgtgatcagcagcgagcacatcgtggagagagaggccgagaccagcttcagcaccagccactacaccagcaccgcccaccacagcaccaccgtgacccagacccccagccacagctggagcaacggccacaccgagagcatcctgagcgagagccacagcgtgatcgtgatgagcagcgtggagaacagcagacacagcagccccaccggcggccccagaggcagactgaacggcaccggcggccccagagagtgcaacagcttcctgagacacgccagagagacccccgacagctacagagacagcccccacagcgagagatacgtgagcgccatgaccacccccgccagaatgagccccgtggacttccacacccccagcagccccaagagcccccccagcgagatgagcccccccgtgagcagcatgaccgtgagcatgcccagcatggccgtgagccccttcatggaggaggagagacccctgctgctggtgaccccccccagactgagagagaagaagttcgaccaccacccccagcagttcagcagcttccaccacaaccccgcccacgacagcaacagcctgcccgccagccccctgagaatcgtggaggacgaggagtacgagaccacccaggagtacgagcccgcccaggagcccgtgaagaagctggccaacagcagaagagccaagagaaccaagcccaacggccacatcgccaacagactggaggtggacagcaacaccagcagccagagcagcaacagcgagagcgagaccgaggacgagagagtgggcgaggacacccccttcctgggcatccagaaccccctggccgccagcctggaggccacccccgccttcagactggccgacagcagaaccaaccccgccggcagattcagcacccaggaggagatccaggccagactgagcagcgtgatcgccaaccaggaccccatcgccgtgtag

SEQ ID NO: 2082 - DNA, 1947 bp, Artificial Sequence
  Description of Artificial Sequence: Synthetic coding sequence
atgagcgagagaaaggagggcagaggcaagggcaagggcaagaagaaggagagaggcagcggcaagaagcccgagagcgccgccggcagccagagccccgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgagatcatcaccggcatgcccgccagcaccgagggcgcctacgtgagcagcgagagccccatcagaatcagcgtgagcaccgagggcgccaacaccagcagcagcaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccagcccggcttcaccggcgccagatgcaccgagaacgtgcccatgaaggtgcagaaccaggagaagcacagcggcgagcccttccccgaggccgaggagctgtaccagaagagagtgctgaccatcaccggcatctgcatcgccctgctggtggtgggcatcatgtgcgtggtggcctactgcaagaccaagaagcagagaaagaagctgcacgacagactgagacagagcctgagaagcgagagaaacaacatgatgaacatcgccaacggcccccaccaccccaaccccccccccgagaacgtgcagctggtgaaccagtacgtgagcaagaacgtgatcagcagcgagcacatcgtggagagagaggccgagaccagcttcagcaccagccactacaccagcaccgcccaccacagcaccaccgtgacccagacccccagccacagctggagcaacggccacaccgagagcatcctgagcgagagccacagcgtgatcgtgatgagcagcgtggagaacagcagacacagcagccccaccggcggccccagaggcagactgaacggcaccggcggccccagagagtgcaacagcttcctgagacacgccagagagacccccgacagctacagagacagcccccacagcgagagatacgtgagcgccatgaccacccccgccagaatgagccccgtggacttccacacccccagcagccccaagagcccccccagcgagatgagcccccccgtgagcagcatgaccgtgagcatgcccagcatggccgtgagccccttcatggaggaggagagacccctgctgctggtgaccccccccagactgagagagaagaagttcgaccaccacccccagcagttcagcagcttccaccacaaccccgcccacgacagcaacagcctgcccgccagccccctgagaatcgtggaggacgaggagtacgagaccacccaggagtacgagcccgcccaggagcccgtgaagaagctggccaacagcagaagagccaagagaaccaagcccaacggccacatcgccaacagactggaggtggacagcaacaccagcagccagagcagcaacagcgagagcgagaccgaggacgagagagtgggcgaggacacccccttcctgggcatccagaaccccctggccgccagcctggaggccacccccgccttcagactggccgacagcagaaccaaccccgccggcagattcagcacccaggaggagatccaggccagactgagcagcgtgatcgccaaccaggaccccatcgccgtgtag

SEQ ID NO: 2083 - DNA, 744 bp, Artificial Sequence
  Description of Artificial Sequence: Synthetic coding sequence
atgagcgagagaaaggagggcagaggcaagggcaagggcaagaagaaggagagaggcagcggcaagaagcccgagagcgccgccggcagccagagccccgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgagatcatcaccggcatgcccgccagcaccgagggcgcctacgtgagcagcgagagccccatcagaatcagcgtgagcaccgagggcgccaacaccagcagcagcaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccagcccggcttcaccggcgccagatgcaccgagaacgtgcccatgaaggtgcagaaccaggagagcgcccagatgagcctgctggtgatcgccgccaagaccacctag

SEQ ID NO: 2084 - DNA, 1938 bp, Artificial Sequence
  Description of Artificial Sequence: Synthetic coding sequence
atgagcgagagaaaggagggcagaggcaagggcaagggcaagaagaaggagagaggcagcggcaagaagcccgagagcgccgccggcagccagagccccgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgagatcatcaccggcatgcccgccagcaccgagggcgcctacgtgagcagcgagagccccatcagaatcagcgtgagcaccgagggcgccaacaccagcagcagcaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccccaacgagttcaccggcgacagatgccagaactacgtgatggccagcttctacaagcacctgggcatcgagttcatggaggccgaggagctgtaccagaagagagtgctgaccatcaccggcatctgcatcgccctgctggtggtgggcatcatgtgcgtggtggcctactgcaagaccaagaagcagagaaagaagctgcacgacagactgagacagagcctgagaagcgagagaaacaacatgatgaacatcgccaacggcccccaccaccccaaccccccccccgagaacgtgcagctggtgaaccagtacgtgagcaagaacgtgatcagcagcgagcacatcgtggagagagaggccgagaccagcttcagcaccagccactacaccagcaccgcccaccacagcaccaccgtgacccagacccccagccacagctggagcaacggccacaccgagagcatcctgagcgagagccacagcgtgatcgtgatgagcagcgtggagaacagcagacacagcagccccaccggcggccccagaggcagactgaacggcaccggcggccccagagagtgcaacagcttcctgagacacgccagagagacccccgacagctacagagacagcccccacagcgagagatacgtgagcgccatgaccacccccgccagaatgagccccgtggacttccacacccccagcagccccaagagcccccccagcgagatgagcccccccgtgagcagcatgaccgtgagcatgcccagcatggccgtgagccccttcatggaggaggagagacccctgctgctggtgaccccccccagactgagagagaagaagttcgaccaccacccccagcagttcagcagcttccaccacaaccccgcccacgacagcaacagcctgcccgccagccccctgagaatcgtggaggacgaggagtacgagaccacccaggagtacgagcccgcccaggagcccgtgaagaagctggccaacagcagaagagccaagagaaccaagcccaacggccacatcgccaacagactggaggtggacagcaacaccagcagccagagcagcaacagcgagagcgagaccgaggacgagagagtgggcgaggacacccccttcctgggcatccagaaccccctggccgccagcctggaggccacccccgccttcagactggccgacagcagaaccaaccccgccggcagattcagcacccaggaggagatccaggccagactgagcagcgtgatcgccaaccaggaccccatcgccgtgtag

SEQ ID NO: 2085 - DNA, 1923 bp, Artificial Sequence; identical to SEQ ID NO: 2079
  Description of Artificial Sequence: Synthetic coding sequence

SEQ ID NO: 2086 - DNA, 1773 bp, Artificial Sequence
  Description of Artificial Sequence: Synthetic coding sequence
atgggcaagggcagagccggcagagtgggcaccaccgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgccaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccccaacgagttcaccggcgacagatgccagaactacgtgatggccagcttctacaagcacctgggcatcgagttcatggaggccgaggagctgtaccagaagagagtgctgaccatcaccggcatctgcatcgccctgctggtggtgggcatcatgtgcgtggtggcctactgcaagaccaagaagcagagaaagaagctgcacgacagactgagacagagcctgagaagcgagagaaacaacatgatgaacatcgccaacggcccccaccaccccaaccccccccccgagaacgtgcagctggtgaaccagtacgtgagcaagaacgtgatcagcagcgagcacatcgtggagagagaggccgagaccagcttcagcaccagccactacaccagcaccgcccaccacagcaccaccgtgacccagacccccagccacagctggagcaacggccacaccgagagcatcctgagcgagagccacagcgtgatcgtgatgagcagcgtggagaacagcagacacagcagccccaccggcggccccagaggcagactgaacggcaccggcggccccagagagtgcaacagcttcctgagacacgccagagagacccccgacagctacagagacagcccccacagcgagagatacgtgagcgccatgaccacccccgccagaatgagccccgtggacttccacacccccagcagccccaagagcccccccagcgagatgagcccccccgtgagcagcatgaccgtgagcatgcccagcatggccgtgagccccttcatggaggaggagagacccctgctgctggtgaccccccccagactgagagagaagaagttcgaccaccacccccagcagttcagcagcttccaccacaaccccgcccacgacagcaacagcctgcccgccagccccctgagaatcgtggaggacgaggagtacgagaccacccaggagtacgagcccgcccaggagcccgtgaagaagctggccaacagcagaagagccaagagaaccaagcccaacggccacatcgccaacagactggaggtggacagcaacaccagcagccagagcagcaacagcgagagcgagaccgaggacgagagagtgggcgaggacacccccttcctgggcatccagaaccccctggccgccagcctggaggccacccccgccttcagactggccgacagcagaaccaaccccgccggcagattcagcacccaggaggagatccaggccagactgagcagcgtgatcgccaaccaggaccccatcgccgtgtag

SEQ ID NO: 2087 - DNA, 1269 bp, Artificial Sequence
  Description of Artificial Sequence: Synthetic coding sequence
atgagatggagaagagcccccagaagaagcggcagacccggccccagagcccagagacccggcagcgccgccagaagcagcccccccctgcccctgctgcccctgctgctgctgctgggcaccgccgccctggcccccggcgccgccgccggcaacgaggccgcccccgccggcgccagcgtgtgctacagcagcccccccagcgtgggcagcgtgcaggagctggcccagagagccgccgtggtgatcgagggcaaggtgcacccccagagaagacagcagggcgccctggacagaaaggccgccgccgccgccggcgaggccggcgcctggggcggcgacagagagccccccgccgccggccccagagccctgggcccccccgccgaggagcccctgctggccgccaacggcaccgtgcccagctggcccaccgcccccgtgcccagcgccggcgagcccggcgaggaggccccctacctggtgaaggtgcaccaggtgtgggccgtgaaggccggcggcctgaagaaggacagcctgctgaccgtgagactgggcacctggggccaccccgccttccccagctgcggcagactgaaggaggacagcagatacatcttcttcatggagcccgacgccaacagcaccagcagagcccccgccgccttcagagccagcttcccccccctggagaccggcagaaacctgaagaaggaggtgagcagagtgctgtgcaagagatgcgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgccaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccccaacgagttcaccggcgacagatgccagaactacgtgatggccagcttctacagcaccagcacccccttcctgagcctgcccgagtag

SEQ ID NO: 2088 - DNA, 891 bp, Artificial Sequence
  Description of Artificial Sequence: Synthetic coding sequence
atggagatctacagccccgacatgagcgaggtggccgccgagagaagcagcagccccagcacccagctgagcgccgaccccagcctggacggcctgcccgccgccgaggacatgcccgagccccagaccgaggacggcagaacccccggcctggtgggcctggccgtgccctgctgcgcctgcctggaggccgagagactgagaggctgcctgaacagcgagaagatctgcatcgtgcccatcctggcctgcctggtgagcctgtgcctgtgcatcgccggcctgaagtgggtgttcgtggacaagatcttcgagtacgacagccccacccacctggaccccggcggcctgggccaggaccccatcatcagcctggacgccaccgccgccagcgccgtgtgggtgagcagcgaggcctacaccagccccgtgagcagagcccagagcgagagcgaggtgcaggtgaccgtgcagggcgacaaggccgtggtgagcttcgagcccagcgccgcccccacccccaagaacagaatcttcgccttcagcttcctgcccagcaccgcccccagcttccccagccccaccagaaaccccgaggtgagaacccccaagagcgccacccagccccagaccaccgagaccaacctgcagaccgcccccaagctgagcaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccccaacgagttcaccggcgacagatgccagaactacgtgatggccagcttctacagcaccagcacccccttcctgagcctgcccgagtag

SEQ ID NO: 2089 - DNA, 1389 bp, Artificial Sequence
  Description of Artificial Sequence: Synthetic coding sequence
atgagcgagagaaaggagggcagaggcaagggcaagggcaagaagaaggagagaggcagcggcaagaagcccgagagcgccgccggcagccagagccccgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgagatcatcaccggcatgcccgccagcaccgagggcgcctacgtgagcagcgagagccccatcagaatcagcgtgagcaccgagggcgccaacaccagcagcagcaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccagcccggcttcaccggcgccagatgcaccgagaacgtgcccatgaaggtgcagaaccaggagaaggccgaggagctgtaccagaagagagtgctgaccatcaccggcatctgcatcgccctgctggtggtgggcatcatgtgcgtggtggcctactgcaagaccaagaagcagagaaagaagctgcacgacagactgagacagagcctgagaagcgagagaaacaacatgatgaacatcgccaacggcccccaccaccccaaccccccccccgagaacgtgcagctggtgaaccagtacgtgagcaagaacgtgatcagcagcgagcacatcgtggagagagaggccgagaccagcttcagcaccagccactacaccagcaccgcccaccacagcaccaccgtgacccagacccccagccacagctggagcaacggccacaccgagagcatcctgagcgagagccacagcgtgatcgtgatgagcagcgtggagaacagcagacacagcagccccaccggcggccccagaggcagactgaacggcaccggcggccccagagagtgcaacagcttcctgagacacgccagagagacccccgacagctacagagacagcccccacagcgagagacacaacctgatcgccgagctgagaagaaacaaggcccacagaagcaagtgcatgcagatccagctgagcgccacccacctgagaagcagcagcatcccccacctgggcttcatcctgtag

SEQ ID NO: 2090 - DNA, 1452 bp, Artificial Sequence
  Description of Artificial Sequence: Synthetic coding sequence
atgcagatccccaagcacatcagcatcgaggacatcaccgccaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccccaacgagttcaccggcgacagatgccagaactacgtgatggccagcttctacaaggccgaggagctgtaccagaagagagtgctgaccatcaccggcatctgcatcgccctgctggtggtgggcatcatgtgcgtggtggcctactgcaagaccaagaagcagagaaagaagctgcacgacagactgagacagagcctgagaagcgagagaaacaacatgatgaacatcgccaacggcccccaccaccccaaccccccccccgagaacgtgcagctggtgaaccagtacgtgagcaagaacgtgatcagcagcgagcacatcgtggagagagaggccgagaccagcttcagcaccagccactacaccagcaccgcccaccacagcaccaccgtgacccagacccccagccacagctggagcaacggccacaccgagagcatcctgagcgagagccacagcgtgatcgtgatgagcagcgtggagaacagcagacacagcagccccaccggcggccccagaggcagactgaacggcaccggcggccccagagagtgcaacagcttcctgagacacgccagagagacccccgacagctacagagacagcccccacagcgagagatacgtgagcgccatgaccacccccgccagaatgagccccgtggacttccacacccccagcagccccaagagcccccccagcgagatgagcccccccgtgagcagcatgaccgtgagcatgcccagcatggccgtgagccccttcatggaggaggagagacccctgctgctggtgaccccccccagactgagagagaagaagttcgaccaccacccccagcagttcagcagcttccaccacaaccccgcccacgacagcaacagcctgcccgccagccccctgagaatcgtggaggacgaggagtacgagaccacccaggagtacgagcccgcccaggagcccgtgaagaagctggccaacagcagaagagccaagagaaccaagcccaacggccacatcgccaacagactggaggtggacagcaacaccagcagccagagcagcaacagcgagagcgagaccgaggacgagagagtgggcgaggacacccccttcctgggcatccagaaccccctggccgccagcctggaggccacccccgccttcagactggccgacagcagaaccaaccccgccggcagattcagcacccaggaggagatccaggccagactgagcagcgtgatcgccaaccaggaccccatcgccgtgtag

SEQ ID NO: 2091 - DNA, 1263 bp, Artificial Sequence
  Description of Artificial Sequence: Synthetic coding sequence
atgagcgagagaaaggagggcagaggcaagggcaagggcaagaagaaggagagaggcagcggcaagaagcccgagagcgccgccggcagccagagccccgccctgccccccagactgaaggagatgaagagccaggagagcgccgccggcagcaagctggtgctgagatgcgagaccagcagcgagtacagcagcctgagattcaagtggttcaagaacggcaacgagctgaacagaaagaacaagccccagaacatcaagatccagaagaagcccggcaagagcgagctgagaatcaacaaggccagcctggccgacagcggcgagtacatgtgcaaggtgatcagcaagctgggcaacgacagcgccagcgccaacatcaccatcgtggagagcaacgagatcatcaccggcatgcccgccagcaccgagggcgcctacgtgagcagcgagagccccatcagaatcagcgtgagcaccgagggcgccaacaccagcagcagcaccagcaccagcaccaccggcaccagccacctggtgaagtgcgccgagaaggagaagaccttctgcgtgaacggcggcgagtgcttcatggtgaaggacctgagcaaccccagcagatacctgtgcaagtgccccaacgagttcaccggcgacagatgccagaactacgtgatggccagcttctacaaggccgaggagctgtaccagaagagagtgctgaccatcaccggcatctgcatcgccctgctggtggtgggcatcatgtgcgtggtggcctactgcaagaccaagaagcagagaaagaagctgcacgacagactgagacagagcctgagaagcgagagaaacaacatgatgaacatcgccaacggcccccaccaccccaaccccccccccgagaacgtgcagctggtgaaccagtacgtgagcaagaacgtgatcagcagcgagcacatcgtggagagagaggccgagaccagcttcagcaccagccactacaccagcaccgcccaccacagcaccaccgtgacccagacccccagccacagctggagcaacggccacaccgagagcatcctgagcgagagccacagcgtgatcgtgatgagcagcgtggagaacagcagacacagcagccccaccggcggccccagaggcagactgaacggcaccggcggccccagagagtgcaacagcttcctgagacacgccagagagacccccgacagctacagagacagcccccacagcgagagatag

SEQ ID NO: 2092 - DNA, 1065 bp, Artificial Sequence
  Description of Artificial Sequence: Synthetic coding sequence
atgctgttcaacctgagaatcctgctgaacaacgccgccttcagaaacggccacaacttcatggtgagaaacttcagatgcggccagcccctgcagaacaaggtgcagctgaagggcagagacctgctgaccctgaagaacttcaccggcgaggagatcaagtacatgctgtggctgagcgccgacctgaagttcagaatcaagcagaagggcgagtacctgcccctgctgcagggcaagagcctgggcatgatcttcgagaagagaagcaccagaaccagactgagcaccgagaccggcttcgccctgctgggcggccacccctgcttcctgaccacccaggacatccacctgggcgtgaacgagagcctgaccgacaccgccagagtgctgagcagcatggccgacgccgtgctggccagagtgtacaagcagagcgacctggacaccctggccaaggaggccagcatccccatcatcaacggcctgagcgacctgtaccaccccatccagatcctggccgactacctgaccctgcaggagcactacagcagcctgaagggcctgaccctgagctggatcggcgacggcaacaacatcctgcacagcatcatgatgagcgccgccaagttcggcatgcacctgcaggccgccacccccaagggctacgagcccgacgccagcgtgaccaagctggccgagcagtacgccaaggagaacggcaccaagctgctgctgaccaacgaccccctggaggccgcccacggcggcaacgtgctgatcaccgacacctggatcagcatgggccaggaggaggagaagaagaagagactgcaggccttccagggctaccaggtgaccatgaagaccgccaaggtggccgccagcgactggaccttcctgcactgcctgcccagaaagcccgaggaggtggacgacgaggtgttctacagccccagaagcctggtgttccccgaggccgagaacagaaagtggaccatcatggccgtgatggtgagcctgctgaccgactacagcccccagctgcagaagcccaagttctag

SEQ ID NO: 2093 - DNA, 348 bp, Artificial Sequence
  Description of Artificial Sequence: Synthetic coding sequence
atgatccccgccaaggacatggccaaggtgatgatcgtgatgctggccatctgcttcctgaccaagagcgacggcaagagcgtgaagaagagaagcgtgagcgagatccagctgatgcacaacctgggcaagcacctgaacagcatggagagagtggagtggctgagaaagaagctgcaggacgtgcacaacttcgtggccctgggcgcccccctggcccccagagacgccggcagccagagacccagaaagaaggaggacaacgtgctggtggagagccacgagaagagcctgggcgaggccgacaaggccgacgtgaacgtgctgaccaaggccaagagccagtag

SEQ ID NO: 2094 - DNA, 348 bp, Artificial Sequence; identical to SEQ ID NO: 2093
  Description of Artificial Sequence: Synthetic coding sequence

SEQ ID NO: 2095 - DNA, 354 bp, Artificial Sequence
  Description of Artificial Sequence: Synthetic coding sequence
atgagcaccgccgtgctggagaaccccggcctgggcagaaagctgagcgacttcggccaggagaccagctacatcgaggacaactgcaaccagaacggcgccatcagcctgatcttcagcctgaaggaggaggtgggcgccctggccaaggtgctgagactgttcgaggagaacgacgtgaacctgacccacatcgagagcagacccagcagactgaagaaggacgagtacgagttcttcacccacctggacaagagaagcctgcccgccctgaccaacatcatcaagatcctgagacacgacatcggcgccaccgtgcacgagctgagcagagacaagaagaaggacacctag

SEQ ID NO: 2096 - DNA, 411 bp, Artificial Sequence
  Description of Artificial Sequence: Synthetic coding sequence
atgagcaccgccgtgctggagaaccccggcctgggcagaaagctgagcgacttcggccaggagaccagctacatcgaggacaactgcaaccagaacggcgccatcagcctgatcttcagcctgaaggaggaggtgggcgccctggccaaggtgctgagactgttcgaggagaacgacgtgaacctgacccacatcgagagcagacccagcagactgaagaaggacgagtacgagttcttcacccacctggacaagagaagcctgcccgccctgaccaacatcatcaagatcctgagacacgacatcggcgccaccgtgcacgagctgagcagagacaagaagaaggacaccgtgccctggttccccagaaccatccaggagctggacagattcgccaaccagatcctgtag

SEQ ID NO: 2097 - DNA, 1359 bp, Artificial Sequence
  Description of Artificial Sequence: Synthetic coding sequence
atgagcaccgccgtgctggagaaccccggcctgggcagaaagctgagcgacttcggccaggagaccagctacatcgaggacaactgcaaccagaacggcgccatcagcctgatcttcagcctgaaggaggaggtgggcgccctggccaaggtgctgagactgttcgaggagaacgacgtgaacctgacccacatcgagagcagacccagcagactgaagaaggacgagtacgagttcttcacccacctggacaagagaagcctgcccgccctgaccaacatcatcaagatcctgagacacgacatcggcgccaccgtgcacgagctgagcagagacaagaagaaggacaccgtgccctggttccccagaaccatccaggagctggacagattcgccaaccagatcctgagctacggcgccgagctggacgccgaccaccccggcttcaaggaccccgtgtacagagccagaagaaagcagttcgccgacatcgcctacaactacagacacggccagcccatccccagagtggagtacatggaggaggagaagaagacctggggcaccgtgttcaagaccctgaagagcctgtacaagacccacgcctgctacgagtacaaccacatcttccccctgctggagaagtactgcggcttccacgaggacaacatcccccagctggaggacgtgagccagttcctgcagacctgcaccggcttcagactgagacccgtggccggcctgctgagcagcagagacttcctgggcggcctggccttcagagtgttccactgcacccagtacatcagacacggcagcaagcccatgtacacccccgagcccgacatctgccacgagctgctgggccacgtgcccctgttcagcgacagaagcttcgcccagttcagccaggagatcggcctggccagcctgggcgcccccgacgagtacatcgagaagctggccaccatctactggttcaccgtggagttcggcctgtgcaagcagggcgacagcatcaaggcctacggcgccggcctgctgagcagcttcggcgagctgcagtactgcctgagcgagaagcccaagctgctgcccctggagctggagaagaccgccatccagaactacaccgtgaccgagttccagcccctgtactacgtggccgagagcttcaacgacgccaaggagaaggtgagaaacttcgccgccaccatccccagacccttcagcgtgagatacgacccctacacccagagaatcgaggtgctggacaacacccagcagctgaagatcctggccgacagcatcaacagcgagatcggcatcctgtgcagcgccctgcagaagatcaagtag

SEQ ID NO: 2098 - DNA, 3261 bp, Artificial Sequence
  Description of Artificial Sequence: Synthetic coding sequence
atggcctgcagccccgacgccgtggtgagccccagcagcgccttcctgagaagcggcagcgtgtacgagcccctgaagagcatcaacctgcccagacccgacaacgagaccctgtgggacaagctggaccactactacagaatcgtgaagagcaccctgctgctgtaccagagccccaccaccggcctgttccccaccaagacctgcggcggcgaccagaaggccaagatccaggacagcctgtactgcgccgccggcgcctgggccctggccctggcctacagaagaatcgacgacgacaagggcagaacccacgagctggagcacagcgccatcaagtgcatgagaggcatcctgtactgctacatgagacaggccgacaaggtgcagcagttcaagcaggaccccagacccaccacctgcctgcacagcgtgttcaacgtgcacaccggcgacgagctgctgagctacgaggagtacggccacctgcagatcaacgccgtgagcctgtacctgctgtacctggtggagatgatcagcagcggcctgcagatcatctacaacaccgacgaggtgagcttcatccagaacctggtgttctgcgtggagagagtgtacagagtgcccgacttcggcgtgtgggagagaggcagcaagtacaacaacggcagcaccgagctgcacagcagcagcgtgggcctggccaaggccgccctggaggccatcaacggcttcaacctgttcggcaaccagggctgcagctggagcgtgatcttcgtggacctggacgcccacaacagaaacagacagaccctgtgcagcctgctgcccagagagagcagaagccacaacaccgacgccgccctgctgccctgcatcagctaccccgccttcgccctggacgacgaggtgctgttcagccagaccctggacaaggtggtgagaaagctgaagggcaagtacggcttcaagagattcctgagagacggctacagaaccagcctggaggaccccaacagatgctactacaagcccgccgagatcaagctgttcgacggcatcgagtgcgagttccccatcttcttcctgtacatgatgatcgacggcgtgttcagaggcaaccccaagcaggtgcaggagtaccaggacctgctgacccccgtgctgcaccacaccaccgagggctaccccgtggtgcccaagtactactacgtgcccgccgacttcgtggagtacgagaagaacaaccccggcagccagaagagattccccagcaactgcggcagagacggcaagctgttcctgtggggccaggccctgtacatcatcgccaagctgctggccgacgagctgatcagccccaaggacatcgaccccgtgcagagatacgtgcccctgaaggaccagagaaacgtgagcatgagattcagcaaccagggccccctggagaacgacctggtggtgcacgtggccctgatcgccgagagccagagactgcaggtgttcctgaacacctacggcatccagacccagaccccccagcaggtggagcccatccagatctggccccagcaggagctggtgaaggcctacctgcagctgggcatcaacgagaagctgggcctgagcggcagacccgacagacccatcggctgcctgggcaccagcaagatctacagaatcctgggcaagaccgtggtgtgctaccccatcatcttcgacctgagcgacttctacatgagccaggacgtgttcctgctgatcgacgacatcaagaacgccctgcagttcatcaagcagtactggaagatgcacggcagacccctgttcctggtgctgatcagagaggacaacatcagaggcagcagattcaaccccatcctggacatgctggccgccctgaagaagggcatcatcggcggcgtgaaggtgcacgtggacagactgcagaccctgatcagcggcgccgtggtggagcagctggacttcctgagaatcagcgacaccgaggagctgcccgagttcaagagcttcgaggagctggagccccccaagcacagcaaggtgaagagacagagcagcacccccagcgcccccgagctgggccagcagcccgacgtgaacatcagcgagtggaaggacaagcccacccacgagatcctgcagaagctgaacgactgcagctgcctggccagccaggccatcctgctgggcatcctgctgaagagagagggccccaacttcatcaccaaggagggcaccgtgagcgaccacatcgagagagtgtacagaagagccggcagccagaagctgtggagcgtggtgagaagagccgccagcctgctgagcaaggtggtggacagcctggcccccagcatcaccaacgtgctggtgcagggcaagcaggtgaccctgggcgccttcggccacgaggaggaggtgatcagcaaccccctgagccccagagtgatccagaacatcatctactacaagtgcaacacccacgacgagagagaggccgtgatccagcaggagctggtgatccacatcggctggatcatcagcaacaaccccgagctgttcagcggcatgctgaagatcagaatcggctggatcatccacgccatggagtacgagctgcagatcagaggcggcgacaagcccgccctggacctgtaccagctgagccccagcgaggtgaagcagctgctgctggacatcctgcagccccagcagaacggcagatgctggctgaacagaagacagatcgacggcagcctgaacagaacccccaccggcttctacgacagagtgtggcagatcctggagagaacccccaacggcatcatcgtggccggcaagcacctgccccagcagcccaccctgagcgacatgaccatgtacgagatgaacttcagcctgctggtggaggacaccctgggcaacatcgaccagccccagtacagacagatcgtggtggagctgctgatggtggtgagcatcgtgctggagagaaaccccgagctggagttccaggacaaggtggacctggacagactggtgaaggaggccttcaacgagttccagaaggaccagagcagactgaaggagatcgagaagcaggacgacatgaccagcttctacaacaccccccccctgggcaagagaggcacctgcagctacctgaccaaggccgtgatgaacctgctgctggagggcgaggtgaagcccaacaacgacgacccctgcctgatcagctag

SEQ ID NO: 2099 - DNA, 1221 bp, Artificial Sequence
  Description of Artificial Sequence: Synthetic coding sequence
atgaccctggacgtgggccccgaggacgagctgcccgactgggccgccgccaaggagttctaccagaagtacgaccccaaggacgtgatcggcagaggcgtgagcagcgtggtgagaagatgcgtgcacagagccaccggccacgagttcgccgtgaagatcatggaggtgaccgccgagagactgagccccgagcagctggaggaggtgagagaggccaccagaagagagacccacatcctgagacaggtggccggccacccccacatcatcaccctgatcgacagctacgagagcagcagcttcatgttcctggtgttcgacctgatgagaaagggcgagctgttcgactacctgaccgagaaggtggccctgagcgagaaggagaccagaagcatcatgagaagcctgctggaggccgtgagcttcctgcacgccaacaacatcgtgcacagagacctgaagcccgagaacatcctgctggacgacaacatgcagatcagactgagcgacttcggcttcagctgccacctggagcccggcgagaagctgagagagctgtgcggcacccccggctacctggcccccgagatcctgaagtgcagcatggacgagacccaccccggctacggcaaggaggtggacctgtgggcctgcggcgtgatcctgttcaccctgctggccggcagcccccccttctggcacagaagacagatcctgatgctgagaatgatcatggagggccagtaccagttcagcagccccgagtgggacgacagaagcagcaccgtgaaggacctgatcagcagactgctgcaggtggaccccgaggccagactgaccgccgagcaggccctgcagcaccccttcttcgagagatgcgagggcagccagccctggaacctgacccccagacagagattcagagtggccgtgtggaccgtgctggccgccggcagagtggccctgagcacccacagagtgagacccctgaccaagaacgccctgctgagagacccctacgccctgagaagcgtgagacacctgatcgacaactgcgccttcagactgtacggccactgggtgaagaagggcgagcagcagaacagagccgccctgttccagcacagaccccccggccccttccccatcatgggccccgaggaggagggcgacagcgccgccatcaccgaggacgaggccgtgctggtgctgggctag

SEQ ID NO: 2100 - DNA, 3708 bp, Artificial Sequence
  Description of Artificial Sequence: Synthetic coding sequence
atgagaagcagaagcaacagcggcgtgagactggacggctacgccagactggtgcagcagaccatcctgtgctaccagaaccccgtgaccggcctgctgagcgccagccacgagcagaaggacgcctgggtgagagacaacatctacagcatcctggccgtgtggggcctgggcatggcctacagaaagaacgccgacagagacgaggacaaggccaaggcctacgagctggagcagaacgtggtgaagctgatgagaggcctgctgcagtgcatgatgagacaggtggccaaggtggagaagttcaagcacacccagagcaccaaggacagcctgcacgccaagtacaacaccgccacctgcggcaccgtggtgggcgacgaccagtggggccacctgcaggtggacgccaccagcctgttcctgctgttcctggcccagatgaccgccagcggcctgagaatcatcttcaccctggacgaggtggccttcatccagaacctggtgttctacatcgaggccgcctacaaggtggccgactacggcatgtgggagagaggcgacaagaccaaccagggcatccccgagctgaacgccagcagcgtgggcatggccaaggccgccctggaggccatcgacgagctggacctgttcggcgcccacggcggcagaaagagcgtgatccacgtgctgcccgacgaggtggagcactgccagagcatcctgttcagcatgctgcccagagccagcaccagcaaggagatcgacgccggcctgctgagcatcatcagcttccccgccttcgccgtggaggacgtgaacctggtgaacgtgaccaagaacgagatcatcagcaagctgcagggcagatacggctgctgcagattcctgagagacggctacaagacccccagagaggaccccaacagactgcactacgaccccgccgagctgaagctgttcgagaacatcgagtgcgagtggcccgtgttctggacctacttcatcatcgacggcgtgttcagcggcgacgccgtgcaggtgcaggagtacagagaggccctggagggcatcctgatcagaggcaagaacggcatcagactggtgcccgagctgtacgccgtgccccccaacaaggtggacgaggagtacaagaacccccacaccgtggacagagtgcccatgggcaaggtgccccacctgtggggccagagcctgtacatcctgagcagcctgctggccgagggcttcctggccgccggcgagatcgaccccctgaacagaagattcagcaccagcgtgaagcccgacgtggtggtgcaggtgaccgtgctggccgagaacaaccacatcaaggacctgctgagaaagcacggcgtgaacgtgcagagcatcgccgacatccaccccatccaggtgcagcccggcagaatcctgagccacatctacgccaagctgggcagaaacaagaacatgaacctgagcggcagaccctacagacacatcggcgtgctgggcaccagcaagctgtacgtgatcagaaaccagatcttcaccttcaccccccagttcaccgaccagcaccacttctacctggccctggacaacgagatgatcgtggagatgctgagaatcgagctggcctacctgtgcacctgctggagaatgaccggcagacccaccctgaccttccccatcagcagaaccatgctgaccaacgacggcagcgacatccacagcgccgtgctgagcaccatcagaaagctggaggacggctacttcggcggcgccagagtgaagctgggcaacctgagcgagttcctgaccaccagcttctacacctacctgaccttcctggaccccgactgcgacgagaagctgttcgacaacgccagcgagggcaccttcagccccgacagcgacagcgacctggtgggctacctggaggacacctgcaaccaggagagccaggacgagctggaccactacatcaaccacctgctgcagagcaccagcctgagaagctacctgccccccctgtgcaagaacaccgaggacagacacgtgttcagcgccatccacagcaccagagacatcctgagcgtgatggccaaggccaagggcctggaggtgcccttcgtgcccatgaccctgcccaccaaggtgctgagcgcccacagaaagagcctgaacctggtggacagcccccagcccctgctggagaaggtgcccgagagcgacttccagtggcccagagacgaccacggcgacgtggactgcgagaagctggtggagcagctgaaggactgcagcaacctgcaggaccaggccgacatcctgtacatcctgtacgtgatcaagggccccagctgggacaccaacctgagcggccagcacggcgtgaccgtgcagaacctgctgggcgagctgtacggcaaggccggcctgaaccaggagtggggcctgatcagatacatcagcggcctgctgagaaagaaggtggaggtgctggccgaggcctgcaccgacctgctgagccaccagaagcagctgaccgtgggcctgccccccgagcccagagagaagatcatcagcgcccccctgccccccgaggagctgaccaagctgatctacgaggccagcggccaggacatcagcatcgccgtgctgacccaggagatcgtggtgtacctggccatgtacgtgagagcccagcccagcctgttcgtggagatgctgagactgagaatcggcctgatcatccaggtgatggccaccgagctggccagaagcctgaactgcagcggcgaggaggccagcgagagcctgatgaacctgagccccttcgacatgaagaacctgctgcaccacatcctgagcggcaaggagttcggcgtggagagaagcgtgagacccatccacagcagcaccagcagccccaccatcagcatccacgaggtgggccacaccggcgtgaccaagaccgagagaagcggcatcaacagactgagaagcgagatgaagcagatgaccagaagattcagcgccgacgagcagttcttcagcgtgggccaggccgccagcagcagcgcccacagcagcaagagcgccagaagcagcacccccagcagccccaccggcaccagcagcagcgacagcggcggccaccacatcggctggggcgagagacagggccagtggctgagaagaagaagactggacggcgccatcaacagagtgcccgtgggcttctaccagagagtgtggaagatcctgcagaagtgccacggcctgagcatcgacggctacgtgctgcccagcagcaccaccagagagatgaccccccacgagatcaagttcgccgtgcacgtggagagcgtgctgaacagagtgccccagcccgagtacagacagctgctggtggaggccatcatggtgctgaccctgctgagcgacaccgagatgaccagcatcggcggcatcatccacgtggaccagatcgtgcagatggccagccagctgttcctgcaggaccaggtgagcatcggcgccatggacaccctggagaaggaccaggccaccggcatctgccacttcttctacgacagcgcccccagcggcgcctacggcaccatgacctacctgaccagagccgtggccagctacctgcaggagctgctgcccaacagcggctgccagatgcagtag

SEQ ID NO: 2101 - DNA, 3261 bp, Artificial Sequence; identical to SEQ ID NO: 2098
  Description of Artificial Sequence: Synthetic coding sequence

SEQ ID NO: 2102 - DNA, 3282 bp, Artificial Sequence
  Description of Artificial Sequence: Synthetic coding sequence
atggccggcgccgccggcctgaccgccgaggtgagctggaaggtgctggagagaagagccagaaccaagagaagcggcagcgtgtacgagcccctgaagagcatcaacctgcccagacccgacaacgagaccctgtgggacaagctggaccactactacagaatcgtgaagagcaccctgctgctgtaccagagccccaccaccggcctgttccccaccaagacctgcggcggcgaccagaaggccaagatccaggacagcctgtactgcgccgccggcgcctgggccctggccctggcctacagaagaatcgacgacgacaagggcagaacccacgagctggagcacagcgccatcaagtgcatgagaggcatcctgtactgctacatgagacaggccgacaaggtgcagcagttcaagcaggaccccagacccaccacctgcctgcacagcgtgttcaacgtgcacaccggcgacgagctgctgagctacgaggagtacggccacctgcagatcaacgccgtgagcctgtacctgctgtacctggtggagatgatcagcagcggcctgcagatcatctacaacaccgacgaggtgagcttcatccagaacctggtgttctgcgtggagagagtgtacagagtgcccgacttcggcgtgtgggagagaggcagcaagtacaacaacggcagcaccgagctgcacagcagcagcgtgggcctggccaaggccgccctggaggccatcaacggcttcaacctgttcggcaaccagggctgcagctggagcgtgatcttcgtggacctggacgcccacaacagaaacagacagaccctgtgcagcctgctgcccagagagagcagaagccacaacaccgacgccgccctgctgccctgcatcagctaccccgccttcgccctggacgacgaggtgctgttcagccagaccctggacaaggtggtgagaaagctgaagggcaagtacggcttcaagagattcctgagagacggctacagaaccagcctggaggaccccaacagatgctactacaagcccgccgagatcaagctgttcgacggcatcgagtgcgagttccccatcttcttcctgtacatgatgatcgacggcgtgttcagaggcaaccccaagcaggtgcaggagtaccaggacctgctgacccccgtgctgcaccacaccaccgagggctaccccgtggtgcccaagtactactacgtgcccgccgacttcgtggagtacgagaagaacaaccccggcagccagaagagattccccagcaactgcggcagagacggcaagctgttcctgtggggccaggccctgtacatcatcgccaagctgctggccgacgagctgatcagccccaaggacatcgaccccgtgcagagatacgtgcccctgaaggaccagagaaacgtgagcatgagattcagcaaccagggccccctggagaacgacctggtggtgcacgtggccctgatcgccgagagccagagactgcaggtgttcctgaacacctacggcatccagacccagaccccccagcaggtggagcccatccagatctggccccagcaggagctggtgaaggcctacctgcagctgggcatcaacgagaagctgggcctgagcggcagacccgacagacccatcggctgcctgggcaccagcaagatctacagaatcctgggcaagaccgtggtgtgctaccccatcatcttcgacctgagcgacttctacatgagccaggacgtgttcctgctgatcgacgacatcaagaacgccctgcagttcatcaagcagtactggaagatgcacggcagacccctgttcctggtgctgatcagagaggacaacatcagaggcagcagattcaaccccatcctggacatgctggccgccctgaagaagggcatcatcggcggcgtgaaggtgcacgtggacagactgcagaccctgatcagcggcgccgtggtggagcagctggacttcctgagaatcagcgacaccgaggagctgcccgagttcaagagcttcgaggagctggagccccccaagcacagcaaggtgaagagacagagcagcacccccagcgcccccgagctgggccagcagcccgacgtgaacatcagcgagtggaaggacaagcccacccacgagatcctgcagaagctgaacgactgcagctgcctggccagccaggccatcctgctgggcatcctgctgaagagagagggccccaacttcatcaccaaggagggcaccgtgagcgaccacatcgagagagtgtacagaagagccggcagccagaagctgtggctggccgtgagatacggcgccgccttcacccagaagttcagcagcagcatcgccccccacatcaccaccttcctggtgcacggcaagcaggtgaccctgggcgccttcggccacgaggaggaggtgatcagcaaccccctgagccccagagtgatccagaacatcatctactacaagtgcaacacccacgacgagagagaggccgtgatccagcaggagctggtgatccacatcggctggatcatcagcaacaaccccgagctgttcagcggcatgctgaagatcagaatcggctggatcatccacgccatggagtacgagctgcagatcagaggcggcgacaagcccgccctggacctgtaccagctgagccccagcgaggtgaagcagctgctgctggacatcctgcagccccagcagaacggcagatgctggctgaacagaagacagatcgacggcagcctgaacagaacccccaccggcttctacgacagagtgtggcagatcctggagagaacccccaacggcatcatcgtggccggcaagcacctgccccagcagcccaccctgagcgacatgaccatgtacgagatgaacttcagcctgctggtggaggacaccctgggcaacatcgaccagccccagtacagacagatcgtggtggagctgctgatggtggtgagcatcgtgctggagagaaaccccgagctggagttccaggacaaggtggacctggacagactggtgaaggaggccttcaacgagttccagaaggaccagagcagactgaaggagatcgagaagcaggacgacatgaccagcttctacaacaccccccccctgggcaagagaggcacctgcagctacctgaccaaggccgtgatgaacctgctgctggagggcgaggtgaagcccaacaacgacgacccctgcctgatcagctag

SEQ ID NO: 2103 - DNA, 3261 bp, Artificial Sequence
  Description of Artificial Sequence: Synthetic coding sequence
atggcctgcagccccgacgccgtggtgagccccagcagcgccttcctgagaagcggcagcgtgtacgagcccctgaagagcatcaacctgcccagacccgacaacgagaccctgtgggacaagctggaccactactacagaatcgtgaagagcaccctgctgctgtaccagagccccaccaccggcctgttccccaccaagacctgcggcggcgaccagaaggccaagatccaggacagcctgtactgcgccgccggcgcctgggccctggccctggcctacagaagaatcgacgacgacaagggcagaacccacgagctggagcacagcgccatcaagtgcatgagaggcatcctgtactgctacatgagacaggccgacaaggtgcagcagttcaagcaggaccccagacccaccacctgcctgcacagcgtgttcaacgtgcacaccggcgacgagctgctgagctacgaggagtacggccacctgcagatcaacgccgtgagcctgtacctgctgtacctggtggagatgatcagcagcggcctgcagatcatctacaacaccgacgaggtgagcttcatccagaacctggtgttctgcgtggagagagtgtacagagtgcccgacttcggcgtgtgggagagaggcagcaagtacaacaacggcagcaccgagctgcacagcagcagcgtgggcctggccaaggccgccctggaggccatcaacggcttcaacctgttcggcaaccagggctgcagctggagcgtgatcttcgtggacctggacgcccacaacagaaacagacagaccctgtgcagcctgctgcccagagagagcagaagccacaacaccgacgccgccctgctgccctgcatcagctaccccgccttcgccctggacgacgaggtgctgttcagccagaccctggacaaggtggtgagaaagctgaagggcaagtacggcttcaagagattcctgagagacggctacagaaccagcctggaggaccccaacagatgctactacaagcccgccgagatcaagctgttcgacggcatcgagtgcgagttccccatcttcttcctgtacatgatgatcgacggcgtgttcagaggcaaccccaagcaggtgcaggagtaccaggacctgctgacccccgtgctgcaccacaccaccgagggctaccccgtggtgcccaagtactactacgtgcccgccgacttcgtggagtacgagaagaacaaccccggcagccagaagagattccccagcaactgcggcagagacggcaagctgttcctgtggggccaggccctgtacatcatcgccaagctgctggccgacgagctgatcagccccaaggacatcgaccccgtgcagagatacgtgcccctgaaggaccagagaaacgtgagcatgagattcagcaaccagggccccctggagaacgacctggtggtgcacgtggccctgatcgccgagagccagagactgcaggtgttcctgaacacctacggcatccagacccagaccccccagcaggtggagcccatccagatctggccccagcaggagctggtgaaggcctacctgcagctgggcatcaacgagaagctgggcctgagcggcagacccgacagacccatcggctgcctgggcaccagcaagatctacagaatcctgggcaagaccgtggtgtgctaccccatcatcttcgacctgagcgacttctacatgagccaggacgtgttcctgctgatcgacgacatcaagaacgccctgcagttcatcaagcagtactggaagatgcacggcagacccctgttcctggtgctgatcagagaggacaacatcagaggcagcagattcaaccccatcctggacatgctggccgccctgaagaagggcatcatcggcggcgtgaaggtgcacgtggacagactgcagaccctgatcagcggcgccgtggtggagcagctggacttcctgagaatcagcgacaccgaggagctgcccgagttcaagagcttcgaggagctggagccccccaagcacagcaaggtgaagagacagagcagcacccccagcgcccccgagctgggccagcagcccgacgtgaacatcagcgagtggaaggacaagcccacccacgagatcctgcagaagctgaacgactgcagctgcctggccagccaggccatcctgctgggcatcctgctgaagagagagggccccaacttcatcaccaaggagggcaccgtgagcgaccacatcgagagagtgtacagaagagccggcagccagaagctgtggctggccgtgagatacggcgccgccttcacccagaagttcagcagcagcatcgccccccacatcaccaccttcctggtgcacggcaagcaggtgaccctgggcgccttcggccacgaggaggaggtgatcagcaaccccctgagccccagagtgatccagaacatcatctactacaagtgcaacacccacgacgagagagaggccgtgatccagcaggagctggtgatccacatcggctggatcatcagcaacaaccccgagctgttcagcggcatgctgaagatcagaatcggctggatcatccacgccatggagtacgagctgcagatcagaggcggcgacaagcccgccctggacctgtaccagctgagccccagcgaggtgaagcagctgctgctggacatcctgcagccccagcagaacggcagatgctggctgaacagaagacagatcgacggcagcctgaacagaacccccaccggcttctacgacagagtgtggcagatcctggagagaacccccaacggcatcatcgtggccggcaagcacctgccccagcagcccaccctgagcgacatgaccatgtacgagatgaacttcagcctgctggtggaggacaccctgggcaacatcgaccagccccagtacagacagatcgtggtggagctgctgatggtggtgagcatcgtgctggagagaaaccccgagctggagttccaggacaaggtggacctggacagactggtgaaggaggccttcaacgagttccagaaggaccagagcagactgaaggagatcgagaagcaggacgacatgaccagcttctacaacaccccccccctgggcaagagaggcacctgcagctacctgaccaaggccgtgatgaacctgctgctggagggcgaggtgaagcccaacaacgacgacccctgcctgatcagctag

SEQ ID NO: 2104 - DNA, 1221 bp, Artificial Sequence; identical to SEQ ID NO: 2099
  Description of Artificial Sequence: Synthetic coding sequence

SEQ ID NO: 2105 - DNA, 1125 bp, Artificial Sequence
  Description of Artificial Sequence: Synthetic coding sequence
atgaccctggacgtgggccccgaggacgagctgcccgactgggccgccgccaaggagttctaccagaagtacgaccccaaggacgtgatcggcagaggcgtgagcagcgtggtgagaagatgcgtgcacagagccaccggccacgagttcgccgtgaagatcatggaggtgaccgccgagagactgagccccgagcagctggaggaggtgagagaggccaccagaagagagacccacatcctgagacaggtggccggccacccccacatcatcaccctgatcgacagctacgagagcagcagcttcatgttcctggtgttcgacctgatgagaaagggcgagctgttcgactacctgaccgagaaggtggccctgagcgagaaggagaccagaagcatcatgagaagcctgctggaggccgtgagcttcctgcacgccaacaacatcgtgcacagagacctgaagcccgagaacatcctgctggacgacaacatgcagatcagactgagcgacttcggcttcagctgccacctggagcccggcgagaagctgagagagctgtgcggcacccccggctacctggcccccgagatcctgaagtgcagcatggacgagacccaccccggctacggcaaggaggtggacctgtgggcctgcggcgtgatcctgttcaccctgctggccggcagcccccccttctggcacagaagacagatcctgatgctgagaatgatcatggagggccagtaccagttcagcagccccgagtgggacgacagaagcagcaccgtgaaggacctgatcagcagactgctgcaggtggaccccgaggccagactgaccgccgagcaggccctgcagcaccccttcttcgagagatgcgagggcagccagccctggaacctgacccccagacagagattcagagtggccgtgtggaccgtgctggccgccggcagagtggccctgagcacccacagagtgagacccctgaccaagaacgccctgctgagagacccctacgccctgagaagcgtgagacacctgatcgacaactgcgccttcagactgtacggccactggatcagaaagcagtggatcggcaagctgatggcctgcgtgtag

SEQ ID NO: 2106 - DNA, 3999 bp, Artificial Sequence
  Description of Artificial Sequence: Synthetic coding sequence
atgcagcaggccccccagccctacgagttcttcagcgaggagaacagccccaagtggagaggcctgctggtgagcgccctgagaaaggtgcaggagcaggtgcaccccaccctgagcgccaacgaggagagcctgtactacatcgaggagctgatcttccagctgctgaacaagctgtgcatggcccagcccagaaccgtgcaggacgtggaggagagagtgcagaagaccttcccccaccccatcgacaagtgggccatcgccgacgcccagagcgccatcgagaagagaaagagaagaaaccccctgctgctgcccgtggacaagatccaccccagcctgaaggaggtgctgggctacaaggtggactaccacgtgagcctgtacatcgtggccgtgctggagtacatcagcgccgacatcctgaagctggccggcaactacgtgttcaacatcagacactacgagatcagccagcaggacatcaaggtgagcatgtgcgccgacaaggtgctgatggacatgttcgaccaggacgacatcggcctggtgagcctgtgcgaggacgagcccagcagcagcggcgagctgaactactacgacctggtgagaaccgagatcgccgaggagagacagtacctgagagagctgaacatgatcatcaaggtgttcagagaggccttcctgagcgacagaaagctgttcaagcccagcgacatcgagaagatcttcagcaacatcagcgacatccacgagctgaccgtgaagctgctgggcctgatcgaggacaccgtggagatgaccgacgagagcagcccccaccccctggccggcagctgcttcgaggacctggccgaggagcaggccttcgacccctacgagaccctgagccaggacatcctgagccccgagttccacgagcacttcaacaagctgatggccagacccgccgtggccctgcacttccagagcatcgccgacggcttcaaggaggccgtgagatacgtgctgcccagactgatgctggtgcccgtgtaccactgctggcactacttcgagctgctgaagcagctgaaggcctgcagcgaggagcaggaggacagagagtgcctgaaccaggccatcaccgccctgatgaacctgcagggcagcatggacagaatctacaagcagtacagccccagaagaagacccggcgaccccgtgtgccccttctacagccaccagctgagaagcaagcacctggccatcaagaagatgaacgagatccagaagaacatcgacggctgggagggcaaggacatcggccagtgctgcaacgagttcatcatggagggccccctgaccagaatcggcgccaagcacgagagacacatcttcctgttcgacggcctgatgatcagctgcaagcccaaccacggccagaccagactgcccggctacagcagcgccgagtacagactgaaggagaagttcgtgatgagaaagatccagatctgcgacaaggaggacacctgcgagcacaagcacgccttcgagctggtgagcaaggacgagaacagcatcatcttcgccgccaagagcgccgaggagaagaacaactggatggccgccctgatcagcctgcactacagaagcaccctggacagaatgctggacagcgtgctgctgaaggaggagaacgagcagcccctgagactgcccagccccgaggtgtacagattcgtggtgaaggacagcgaggagaacatcgtgttcgaggacaacctgcagagcagaagcggcatccccatcatcaagggcggcaccgtggtgaagctgatcgagagactgacctaccacatgtacgccgaccccaacttcgtgagaaccttcctgaccacctacagaagcttctgcaagccccaggagctgctgagcctgctgatcgagagattcgagatccccgagcccgagcccaccgacgccgacaagctggccatcgagaagggcgagcagcccatcagcgccgacctgaagagattcagaaaggagtacgtgcagcccgtgcagctgagaatcctgaacgtgttcagacactgggtggagcaccacttctacgacttcgagagagacctggagctgctggagagactggagagcttcatcagcagcgtgagaggcaaggccatgaagaagtgggtggagagcatcgccaagatcatcagaagaaagaagcaggcccaggccaacggcgtgagccacaacatcaccttcgagagcccccccccccccatcgagtggcacatcagcaagcccggccagttcgagaccttcgacctgatgaccctgcaccccatcgagatcgccagacagctgaccctgctggagagcgacctgtacagaaaggtgcagcccagcgagctggtgggcagcgtgtggaccaaggaggacaaggagatcaacagccccaacctgctgaagatgatcagacacaccaccaacctgaccctgtggttcgagaagtgcatcgtggaggccgagaacttcgaggagagagtggccgtgctgagcagaatcatcgagatcctgcaggtgttccaggacctgaacaacttcaacggcgtgctggagatcgtgagcgccgtgaacagcgtgagcgtgtacagactggaccacaccttcgaggccctgcaggagagaaagagaaagatcctggacgaggccgtggagctgagccaggaccacttcaagaagtacctggtgaagctgaagagcatcaaccccccctgcgtgcccttcttcggcatctacctgaccaacatcctgaagaccgaggagggcaacaacgacttcctgaagaagaagggcaaggacctgatcaacttcagcaagagaagaaaggtggccgagatcaccggcgagatccagcagtaccagaaccagccctactgcctgagaatcgagcccgacatgagaagattcttcgagaacctgaaccccatgggcagcgccagcgagaaggagttcaccgactacctgttcaacaagagcctggagatcgagcccagaaactgcaagcagccccccagattccccagaaagagcaccttcagcctgaagagccccggcatcagacccaacaccggcagacacggcagcaccagcggcaccctgagaggccaccccacccccctggagagagagccctgcaagatcagcttcagcagaatcgccgagaccgagctggagagcaccgtgagcgcccccaccagccccaacacccccagcaccccccccgtgagcgccagcagcgacctgagcgtgttcctggacgtggacctgaacagcagctgcggcagcaacagcatcttcgcccccgtgctgctgccccacagcaagagcttcttcagcagctgcggcagcctgcacaagctgagcgaggagcccctgatccccccccccctgccccccagaaagaagttcgaccacgacgccagcaacagcaagggcaacatgaagagcgacgacgacccccccgccatcccccccagacagccccccccccccaaggtgaagcccagagtgcccgtgcccaccggcgccttcgacggccccctgcacagcccccccccccccccccccagagaccccctgcccgacacccccccccccgtgcccctgagaccccccgagcacttcatcaactgccccttcaacctgcagcccccccccctgggccacctgcacagagacagcgactggctgagagacatcagcacctgccccaacagccccagcaccccccccagcacccccagccccagagtgcccagaagatgctacgtgctgagcagcagccagaacaacctggcccacccccccgccccccccgtgccccccagacagaacagcagcccccacctgcccaagctgccccccaagacctacaagagagagctgagccacccccccctgtacagactgcccctgctggagaacgccgagaccccccagtag

SEQ ID NO: 2107 - DNA, 2442 bp, Artificial Sequence
  Description of Artificial Sequence: Synthetic coding sequence
atggccaagcccctgaccgaccaggagaagagaagacagatcagcatcagaggcatcgtgggcgtggagaacgtggccgagctgaagaagagcttcaacagacacctgcacttcaccctggtgaaggacagaaacgtggccaccaccagagactactacttcgccctggcccacaccgtgagagaccacctggtgggcagatggatcagaacccagcagcactactacgacaagtgccccaagctgggcctggacatcgaggagctggaggagatcgaggaggacgccggcctgggcaacggcggcctgggcagactggccgcctgcttcctggacagcatggccaccctgggcctggccgcctacggctacggcatcagatacgagtacggcatcttcaaccagaagatcagagacggctggcaggtggaggaggccgacgactggctgagatacggcaacccctgggagaagagcagacccgagttcatgctgcccgtgcacttctacggcaaggtggagcacaccaacaccggcaccaagtggatcgacacccaggtggtgctggccctgccctacgacacccccgtgcccggctacatgaacaacaccgtgaacaccatgagactgtggagcgccagagcccccaacgacttcaacctgagagacttcaacgtgggcgactacatccaggccgtgctggacagaaacctggccgagaacatcagcagagtgctgtaccccaacgacaacttcttcgagggcaaggagctgagactgaagcaggagtacttcgtggtggccgccaccctgcaggacatcatcagaagattcaaggccagcaagttcggcagcaccagaggcgccggcaccgtgttcgacgccttccccgaccaggtggccatccagctgaacgacacccaccccgccctggccatccccgagctgatgagaatcttcgtggacatcgagaagctgccctggagcaaggcctgggagctgacccagaagaccttcgcctacaccaaccacaccgtgctgcccgaggccctggagagatggcccgtggacctggtggagaagctgctgcccagacacctggagatcatctacgagatcaaccagaagcacctggacagaatcgtggccctgttccccaaggacgtggacagactgagaagaatgagcctgatcgaggaggagggcagcaagagaatcaacatggcccacctgtgcatcgtgggcagccacgccgtgaacggcgtggccaagatccacagcgacatcgtgaagaccaaggtgttcaaggacttcagcgagctggagcccgacaagttccagaacaagaccaacggcatcacccccagaagatggctgctgctgtgcaaccccggcctggccgagctgatcgccgagaagatcggcgaggactacgtgaaggacctgagccagctgaccaagctgcacagcttcctgggcgacgacgtgttcctgagagagctggccaaggtgaagcaggagaacaagctgaagttcagccagttcctggagaccgagtacaaggtgaagatcaaccccagcagcatgttcgacgtgcaggtgaagagaatccacgagtacaagagacagctgctgaactgcctgcacgtgatcaccatgtacaacagaatcaagaaggaccccaagaagctgttcgtgcccagaaccgtgatcatcggcggcaaggccgcccccggctaccacatggccaagatgatcatcaagctgatcaccagcgtggccgacgtggtgaacaacgaccccatggtgggcagcaagctgaaggtgatcttcctggagaactacagagtgagcctggccgagaaggtgatccccgccaccgacctgagcgagcagatcagcaccgccggcaccgaggccagcggcaccggcaacatgaagttcatgctgaacggcgccctgaccatcggcaccatggacggcgccaacgtggagatggccgaggaggccggcgaggagaacctgttcatcttcggcatgagaatcgacgacgtggccgccctggacaagaagggctacgaggccaaggagtactacgaggccctgcccgagctgaagctggtgatcgaccagatcgacaacggcttcttcagccccaagcagcccgacctgttcaaggacatcatcaacatgctgttctaccacgacagattcaaggtgttcgccgactacgaggcctacgtgaagtgccaggacaaggtgagccagctgtacatgaaccccaaggcctggaacaccatggtgctgaagaacatcgccgccagcggcaagttcagcagcgacagaaccatcaaggagtacgcccagaacatctggaacgtggagcccagcgacctgaagatcagcctgagcaacgagagcaacaaggtgaacggcaactag

SEQ ID NO: 2108 - DNA, 2433 bp, Artificial Sequence
  Description of Artificial Sequence: Synthetic coding sequence
atggagcacaaggaggtggtgctgctgctgctgctgttcctgaagagcggccagggcgagcccctggacgactacgtgaacacccagggcgccagcctgttcagcgtgaccaagaagcagctgggcgccggcagcatcgaggagtgcgccgccaagtgcgaggaggacgaggagttcacctgcagagccttccagtaccacagcaaggagcagcagtgcgtgatcatggccgagaacagaaagagcagcatcatcatcagaatgagagacgtggtgctgttcgagaagaaggtgtacctgagcgagtgcaagaccggcaacggcaagaactacagaggcaccatgagcaagaccaagaacggcatcacctgccagaagtggagcagcaccagcccccacagacccagattcagccccgccacccaccccagcgagggcctggaggagaactactgcagaaaccccgacaacgacccccagggcccctggtgctacaccaccgaccccgagaagagatacgactactgcgacatcctggagtgcgaggaggagtgcatgcactgcagcggcgagaactacgacggcaagatcagcaagaccatgagcggcctggagtgccaggcctgggacagccagagcccccacgcccacggctacatccccagcaagttccccaacaagaacctgaagaagaactactgcagaaaccccgacagagagctgagaccctggtgcttcaccaccgaccccaacaagagatgggagctgtgcgacatccccagatgcaccacccccccccccagcagcggccccacctaccagtgcctgaagggcaccggcgagaactacagaggcaacgtggccgtgaccgtgagcggccacacctgccagcactggagcgcccagaccccccacacccacaacagaacccccgagaacttcccctgcaagaacctggacgagaactactgcagaaaccccgacggcaagagagccccctggtgccacaccaccaacagccaggtgagatgggagtactgcaagatccccagctgcgacagcagccccgtgagcaccgagcagctggcccccaccgccccccccgagctgacccccgtggtgcaggactgctaccacggcgacggccagagctacagaggcaccagcagcaccaccaccaccggcaagaagtgccagagctggagcagcatgaccccccacagacaccagaagacccccgagaactaccccaacgccggcctgaccatgaactactgcagaaaccccgacgccgacaagggcccctggtgcttcaccaccgaccccagcgtgagatgggagtactgcaacctgaagaagtgcagcggcaccgaggccagcgtggtggcccccccccccgtggtgctgctgcccgacgtggagacccccagcgaggaggactgcatgttcggcaacggcaagggctacagaggcaagagagccaccaccgtgaccggcaccccctgccaggactgggccgcccaggagccccacagacacagcatcttcacccccgagaccaaccccagagccggcctggagaagaactactgcagaaaccccgacggcgacgtgggcggcccctggtgctacaccaccaaccccagaaagctgtacgactactgcgacgtgccccagtgcgccgcccccagcttcgactgcggcaagccccaggtggagcccaagaagtgccccggcagagtggtgggcggctgcgtggcccacccccacagctggccctggcaggtgagcctgagaaccagattcggcatgcacttctgcggcggcaccctgatcagccccgagtgggtgctgaccgccgcccactgcctggagaagagccccagacccagcagctacaaggtgatcctgggcgcccaccaggaggtgaacctggagccccacgtgcaggagatcgaggtgagcagactgttcctggagcccaccagaaaggacatcgccctgctgaagctgagcagccccgccgtgatcaccgacaaggtgatccccgcctgcctgcccagccccaactacgtggtggccgacagaaccgagtgcttcatcaccggctggggcgagacccagggcaccttcggcgccggcctgctgaaggaggcccagctgcccgtgatcgagaacaaggtgtgcaacagatacgagttcctgaacggcagagtgcagagcaccgagctgtgcgccggccacctggccggcggcaccgacagctgccagggcgacagcggcggccccctggtgtgcttcgagaaggacaagtacatcctgcagggcgtgaccagctggggcctgggctgcgccagacccaacaagcccggcgtgtacgtgagagtgagcagattcgtgacctggatcgagggcgtgatgagaaacaactag

SEQ ID NO: 2109 - DNA, 633 bp, Artificial Sequence
  Description of Artificial Sequence: Synthetic coding sequence
agattcggcatgcacttctgcggcggcaccctgatcagccccgagtgggtgctgaccgccgcccactgcctggagaagagccccagacccagcagctacaaggtgatcctgggcgcccaccaggaggtgaacctggagccccacgtgcaggagatcgaggtgagcagactgttcctggagcccaccagaaaggacatcgccctgctgaagctgagcagccccgccgtgatcaccgacaaggtgatccccgcctgcctgcccagccccaactacgtggtggccgacagaaccgagtgcttcatcaccggctggggcgagacccagggcaccttcggcgccggcctgctgaaggaggcccagctgcccgtgatcgagaacaaggtgtgcaacagatacgagttcctgaacggcagagtgcagagcaccgagctgtgcgccggccacctggccggcggcaccgacagctgccagggcgacagcggcggccccctggtgtgcttcgagaaggacaagtacatcctgcagggcgtgaccagctggggcctgggctgcgccagacccaacaagcccggcgtgtacgtgagagtgagcagattcgtgacctggatcgagggcgtgatgagaaacaactag

SEQ ID NO: 2110 - DNA, 411 bp, Artificial Sequence
  Description of Artificial Sequence: Synthetic coding sequence
atggagcacaaggaggtggtgctgctgctgctgctgttcctgaagagcggccagggcgagcccctggacgactacgtgaacacccagggcgccagcctgttcagcgtgaccaagaagcagctgggcgccggcagcatcgaggagtgcgccgccaagtgcgaggaggacgaggagttcacctgcagagccttccagtaccacagcaaggagcagcagtgcgtgatcatggccgagaacagaaagagcagcatcatcatcagaatgagagacgtggtgctgttcgagaagaaggtgtacctgagcgagtgcaagaccggcaacggcaagaactacagaggcaccatgagcaagaccaagaacggcatcacctgccagaagtggagcagcaccagcccccacagacccagatag

SEQ ID NO: 2111 - DNA, 945 bp, Artificial Sequence
  Description of Artificial Sequence: Synthetic coding sequence
atgggcatcggcagaagcgagggcggcagaagaggcgccgccctgggcgtgctgctggccctgggcgccgccctgctggccgtgggcagcgccagcgagtacgactacgtgagcttccagagcgacatcggcccctaccagagcggcagattctacaccaagcccccccagtgcgtggacatccccgccgacctgagactgtgccacaacgtgggctacaagaagatggtgctgcccaacctgctggagcacgagaccatggccgaggtgaagcagcaggccagcagctgggtgcccctgctgaacaagaactgccacgccggcacccaggtgttcctgtgcagcctgttcgcccccgtgtgcctggacagacccatctacccctgcagatggctgtgcgaggccgtgagagacagctgcgagcccgtgatgcagttcttcggcttctactggcccgagatgctgaagtgcgacaagttccccgagggcgacgtgtgcatcgccatgaccccccccaacgccaccgaggccagcaagccccagggcaccaccgtgtgccccccctgcgacaacgagctgaagagcgaggccatcatcgagcacctgtgcgccagcgagttcgccctgagaatgaagatcaaggaggtgaagaaggagaacggcgacaagaagatcgtgcccaagaagaagaagcccctgaagctgggccccatcaagaagaaggacctgaagaagctggtgctgtacctgaagaacggcgccgactgcccctgccaccagctggacaacctgagccaccacttcctgatcatgggcagaaaggtgaagagccagtacctgctgaccgccatccacaagtgggacaagaagaacaaggagttcaagaacttcatgaagaagatgaagaaccacgagtgccccaccttccagagcgtgttcaagtag

SEQ ID NO: 2112 - DNA, 882 bp, Artificial Sequence
  Description of Artificial Sequence: Synthetic coding sequence
atggacgccatgaagagaggcctgtgctgcgtgctgctgctgtgcggcgccgtgttcgtgagccccagccaggagatccacgccagattcagaagaggcgccagaagctaccaggtgatctgcagagacgagaagacccagatgatctaccagcagcaccagagctggctgagacccgtgctgagaagcaacagagtggagtactgctggtgcaacagcggcagagcccagtgccacagcgtgcccgtgaagagctgcagcgagcccagatgcttcaacggcggcacctgccagcaggccctgtacttcagcgacttcgtgtgccagtgccccgagggcttcgccggcaagtgctgcgagatcgacaccagagccacctgctacgaggaccagggcatcagctacagaggcacctggagcaccgccgagagcggcgccgagtgcaccaactggaacagcagcgccctggcccagaagccctacagcggcagaagacccgacgccatcagactgggcctgggcaaccacaactactgcagaaaccccgacagagacagcaagccctggtgctacgtgttcaaggccggcaagtacagcagcgagttctgcagcacccccgcctgcagcgagggcaacagcgactgctacttcggcaacggcagcgcctacagaggcacccacagcctgaccgagagcggcgccagctgcctgccctggaacagcatgatcctgatcggcaaggtgtacaccgcccagaaccccagcgcccaggccctgggcctgggcaagcacaactactgcagatgcagaaccggcagaagcgtgagcagccccgccaccgccagcatgagaccctgcctgctgagcatcagaagcggctag

SEQ ID NO: 2113 - DNA, 1551 bp, Artificial Sequence
  Description of Artificial Sequence: Synthetic coding sequence
atggacgccatgaagagaggcctgtgctgcgtgctgctgctgtgcggcgccgtgttcgtgagccccagccaggagatccacgccagattcagaagaggcgccagaagctaccagggctgcagcgagcccagatgcttcaacggcggcacctgccagcaggccctgtacttcagcgacttcgtgtgccagtgccccgagggcttcgccggcaagtgctgcgagatcgacaccagagccacctgctacgaggaccagggcatcagctacagaggcacctggagcaccgccgagagcggcgccgagtgcaccaactggaacagcagcgccctggcccagaagccctacagcggcagaagacccgacgccatcagactgggcctgggcaaccacaactactgcagaaaccccgacagagacagcaagccctggtgctacgtgttcaaggccggcaagtacagcagcgagttctgcagcacccccgcctgcagcgagggcaacagcgactgctacttcggcaacggcagcgcctacagaggcacccacagcctgaccgagagcggcgccagctgcctgccctggaacagcatgatcctgatcggcaaggtgtacaccgcccagaaccccagcgcccaggccctgggcctgggcaagcacaactactgcagaaaccccgacggcgacgccaagccctggtgccacgtgctgaagaacagaagactgacctgggagtactgcgacgtgcccagctgcagcacctgcggcctgagacagtacagccagccccagttcagaatcaagggcggcctgttcgccgacatcgccagccacccctggcaggccgccatcttcgccaagcacagaagaagccccggcgagagattcctgtgcggcggcatcctgatcagcagctgctggatcctgagcgccgcccactgcttccaggagagattccccccccaccacctgaccgtgatcctgggcagaacctacagagtggtgcccggcgaggaggagcagaagttcgaggtggagaagtacatcgtgcacaaggagttcgacgacgacacctacgacaacgacatcgccctgctgcagctgaagagcgacagcagcagatgcgcccaggagagcagcgtggtgagaaccgtgtgcctgccccccgccgacctgcagctgcccgactggaccgagtgcgagctgagcggctacggcaagcacgaggccctgagccccttctacagcgagagactgaaggaggcccacgtgagactgtaccccagcagcagatgcaccagccagcacctgctgaacagaaccgtgaccgacaacatgctgtgcgccggcgacaccagaagcggcggcccccaggccaacctgcacgacgcctgccagggcgacagcggcggccccctggtgtgcctgaacgacggcagaatgaccctggtgggcatcatcagctggggcctgggctgcggccagaaggacgtgcccggcgtgtacaccaaggtgaccaactacctggactggatcagagacaacatgagaccctag

SEQ ID NO: 2114 - DNA, 1689 bp, Artificial Sequence
  Description of Artificial Sequence: Synthetic coding sequence
atggacgccatgaagagaggcctgtgctgcgtgctgctgctgtgcggcgccgtgttcgtgagccccagccaggagatccacgccagattcagaagaggcgccagaagctaccaggtgatctgcagagacgagaagacccagatgatctaccagcagcaccagagctggctgagacccgtgctgagaagcaacagagtggagtactgctggtgcaacagcggcagagcccagtgccacagcgtgcccgtgaagagctgcagcgagcccagatgcttcaacggcggcacctgccagcaggccctgtacttcagcgacttcgtgtgccagtgccccgagggcttcgccggcaagtgctgcgagatcgacaccagagccacctgctacgaggaccagggcatcagctacagaggcacctggagcaccgccgagagcggcgccgagtgcaccaactggaacagcagcgccctggcccagaagccctacagcggcagaagacccgacgccatcagactgggcctgggcaaccacaactactgcagaaaccccgacagagacagcaagccctggtgctacgtgttcaaggccggcaagtacagcagcgagttctgcagcacccccgcctgcagcgagggcaacagcgactgctacttcggcaacggcagcgcctacagaggcacccacagcctgaccgagagcggcgccagctgcctgccctggaacagcatgatcctgatcggcaaggtgtacaccgcccagaaccccagcgcccaggccctgggcctgggcaagcacaactactgcagaaaccccgacggcgacgccaagccctggtgccacgtgctgaagaacagaagactgacctgggagtactgcgacgtgcccagctgcagcacctgcggcctgagacagtacagccagccccagttcagaatcaagggcggcctgttcgccgacatcgccagccacccctggcaggccgccatcttcgccaagcacagaagaagccccggcgagagattcctgtgcggcggcatcctgatcagcagctgctggatcctgagcgccgcccactgcttccaggagagattccccccccaccacctgaccgtgatcctgggcagaacctacagagtggtgcccggcgaggaggagcagaagttcgaggtggagaagtacatcgtgcacaaggagttcgacgacgacacctacgacaacgacatcgccctgctgcagctgaagagcgacagcagcagatgcgcccaggagagcagcgtggtgagaaccgtgtgcctgccccccgccgacctgcagctgcccgactggaccgagtgcgagctgagcggctacggcaagcacgaggccctgagccccttctacagcgagagactgaaggaggcccacgtgagactgtaccccagcagcagatgcaccagccagcacctgctgaacagaaccgtgaccgacaacatgctgtgcgccggcgacaccagaagcggcggcccccaggccaacctgcacgacgcctgccagggcgacagcggcggccccctggtgtgcctgaacgacggcagaatgaccctggtgggcatcatcagctggggcctgggctgcggccagaaggacgtgcccggcgtgtacaccaaggtgaccaactacctggactggatcagagacaacatgagaccctag

SEQ ID NO: 2115 - DNA, 1311 bp, Artificial Sequence
  Description of Artificial Sequence: Synthetic coding sequence
atggacgccatgaagagaggcctgtgctgcgtgctgctgctgtgcggcgccgtgttcgtgagccccagccaggagatccacgccagattcagaagaggcgccagaagctaccaggtgatctgcagagacgagaagacccagatgatctaccagcagcaccagagctggctgagacccgtgctgagaagcaacagagtggagtactgctggtgcaacagcggcagagcccagtgccacagcgtgcccgtgaagagaaacagcgactgctacttcggcaacggcagcgcctacagaggcacccacagcctgaccgagagcggcgccagctgcctgccctggaacagcatgatcctgatcggcaaggtgtacaccgcccagaaccccagcgcccaggccctgggcctgggcaagcacaactactgcagaaaccccgacggcgacgccaagccctggtgccacgtgctgaagaacagaagactgacctgggagtactgcgacgtgcccagctgcagcacctgcggcctgagacagtacagccagccccagttcagaatcaagggcggcctgttcgccgacatcgccagccacccctggcaggccgccatcttcgccaagcacagaagaagccccggcgagagattcctgtgcggcggcatcctgatcagcagctgctggatcctgagcgccgcccactgcttccaggagagattccccccccaccacctgaccgtgatcctgggcagaacctacagagtggtgcccggcgaggaggagcagaagttcgaggtggagaagtacatcgtgcacaaggagttcgacgacgacacctacgacaacgacatcgccctgctgcagctgaagagcgacagcagcagatgcgcccaggagagcagcgtggtgagaaccgtgtgcctgccccccgccgacctgcagctgcccgactggaccgagtgcgagctgagcggctacggcaagcacgaggccctgagccccttctacagcgagagactgaaggaggcccacgtgagactgtaccccagcagcagatgcaccagccagcacctgctgaacagaaccgtgaccgacaacatgctgtgcgccggcgacaccagaagcggcggcccccaggccaacctgcacgacgcctgccagggcgacagcggcggccccctggtgtgcctgaacgacggcagaatgaccctggtgggcatcatcagctggggcctgggctgcggccagaaggacgtgcccggcgtgtacaccaaggtgaccaactacctggactggatcagagacaacatgagaccctag

SEQ ID NO: 2116 - DNA, 1500 bp, Artificial Sequence
  Description of Artificial Sequence: Synthetic coding sequence
atggacgccatgaagagaggcctgtgctgcgtgctgctgctgtgcggcgccgtgttcgtgagccccagccaggagatccacgccagattcagaagaggcgccagaagctaccaggtgatctgcagagacgagaagacccagatgatctaccagcagcaccagagctggctgagacccgtgctgagaagcaacagagtggagtactgctggtgcaacagcggcagagcccagtgccacagcgtgcccgtgaagagctgcagcgagcccagatgcttcaacggcggcacctgccagcaggccctgtacttcagcgacttcgtgtgccagtgccccgagggcttcgccggcaagtgctgcgagatcgacagcaagccctggtgctacgtgttcaaggccggcaagtacagcagcgagttctgcagcacccccgcctgcagcgagggcaacagcgactgctacttcggcaacggcagcgcctacagaggcacccacagcctgaccgagagcggcgccagctgcctgccctggaacagcatgatcctgatcggcaaggtgtacaccgcccagaaccccagcgcccaggccctgggcctgggcaagcacaactactgcagaaaccccgacggcgacgccaagccctggtgccacgtgctgaagaacagaagactgacctgggagtactgcgacgtgcccagctgcagcacctgcggcctgagacagtacagccagccccagttcagaatcaagggcggcctgttcgccgacatcgccagccacccctggcaggccgccatcttcgccaagcacagaagaagccccggcgagagattcctgtgcggcggcatcctgatcagcagctgctggatcctgagcgccgcccactgcttccaggagagattccccccccaccacctgaccgtgatcctgggcagaacctacagagtggtgcccggcgaggaggagcagaagttcgaggtggagaagtacatcgtgcacaaggagttcgacgacgacacctacgacaacgacatcgccctgctgcagctgaagagcgacagcagcagatgcgcccaggagagcagcgtggtgagaaccgtgtgcctgccccccgccgacctgcagctgcccgactggaccgagtgcgagctgagcggctacggcaagcacgaggccctgagccccttctacagcgagagactgaaggaggcccacgtgagactgtaccccagcagcagatgcaccagccagcacctgctgaacagaaccgtgaccgacaacatgctgtgcgccggcgacaccagaagcggcggcccccaggccaacctgcacgacgcctgccagggcgacagcggcggccccctggtgtgcctgaacgacggcagaatgaccctggtgggcatcatcagctggggcctgggctgcggccagaaggacgtgcccggcgtgtacaccaaggtgaccaactacctggactggatcagagacaacatgagaccctag

SEQ ID NO: 2117 - DNA, 537 bp, Artificial Sequence
  Description of Artificial Sequence: Synthetic coding sequence
atggacgccatgaagagaggcctgtgctgcgtgctgctgctgtgcggcgccgtgttcgtgagccccagccaggagatccacgccagattcagaagaggcgccagaagctaccaggtgatctgcagagacgagaagacccagatgatctaccagcagcaccagagctggctgagacccgtgctgagaagcaacagagtggagtactgctggtgcaacagcggcagagcccagtgccacagcgtgcccgtgaagagctgcagcgagcccagatgcttcaacggcggcacctgccagcaggccctgtacttcagcgacttcgtgtgccagtgccccgagggcttcgccggcaagtgctgcgagatcgacaccagagccacctgctacgaggaccagggcatcagctacagaggcacctggagcaccgccgagagcggcgccgagtgcaccaactggaacagcagcgccctggcccagaagccctacagcggcagaagacccgacgccatcagactgggcctgggcaaccacaactactag

SEQ ID NO: 2118 - DNA, 474 bp, Artificial Sequence
  Description of Artificial Sequence: Synthetic coding sequence
atggacgccatgaagagaggcctgtgctgcgtgctgctgctgtgcggcgccgtgttcgtgagccccagccaggagatccacgccagattcagaagaggcgccagaagctaccaggtgatctgcagagacgagaagacccagatgatctaccagcagcaccagagctggctgagacccgtgctgagaagcaacagagtggagtactgctggtgcaacagcggcagagcccagtgccacagcgtgcccgtgaagagctgcagcgagcccagatgcttcaacggcggcacctgccagcaggccctgtacttcagcgacttcgtgtgccagtgccccgagggcttcgccggcaagtgctgcgagatcgacaccagagccacctgctacgaggaccagggcatcagctacagaggcacctggagcaccgccgagagcggcgccgagtgcaccaactggaacagcagcgccctggcctag

SEQ ID NO: 2119 - DNA, 1422 bp, Artificial Sequence
  Description of Artificial Sequence: Synthetic coding sequence
atggacgccatgaagagaggcctgtgctgcgtgctgctgctgtgcggcgccgtgttcgtgagccccagccaggagatccacgccagattcagaagaggcgccagaagctaccaggtgatctgcagagacgagaagacccagatgatctaccagcagcaccagagctggctgagacccgtgctgagaagcaacagagtggagtactgctggtgcaacagcggcagagcccagtgccacagcgtgcccgtgaagagctgcagcgagcccagatgcttcaacggcggcacctgccagcaggccctgtacttcagcgacttcgtgtgccagtgccccgagggcttcgccggcaagtgctgcgagatcggcaacagcgactgctacttcggcaacggcagcgcctacagaggcacccacagcctgaccgagagcggcgccagctgcctgccctggaacagcatgatcctgatcggcaaggtgtacaccgcccagaaccccagcgcccaggccctgggcctgggcaagcacaactactgcagaaaccccgacggcgacgccaagccctggtgccacgtgctgaagaacagaagactgacctgggagtactgcgacgtgcccagctgcagcacctgcggcctgagacagtacagccagccccagttcagaatcaagggcggcctgttcgccgacatcgccagccacccctggcaggccgccatcttcgccaagcacagaagaagccccggcgagagattcctgtgcggcggcatcctgatcagcagctgctggatcctgagcgccgcccactgcttccaggagagattccccccccaccacctgaccgtgatcctgggcagaacctacagagtggtgcccggcgaggaggagcagaagttcgaggtggagaagtacatcgtgcacaaggagttcgacgacgacacctacgacaacgacatcgccctgctgcagctgaagagcgacagcagcagatgcgcccaggagagcagcgtggtgagaaccgtgtgcctgccccccgccgacctgcagctgcccgactggaccgagtgcgagctgagcggctacggcaagcacgaggccctgagccccttctacagcgagagactgaaggaggcccacgtgagactgtaccccagcagcagatgcaccagccagcacctgctgaacagaaccgtgaccgacaacatgctgtgcgccggcgacaccagaagcggcggcccccaggccaacctgcacgacgcctgccagggcgacagcggcggccccctggtgtgcctgaacgacggcagaatgaccctggtgggcatcatcagctggggcctgggctgcggccagaaggacgtgcccggcgtgtacaccaaggtgaccaactacctggactggatcagagacaacatgagaccctag

SEQ ID NO: 2120 - DNA, 1083 bp, Artificial Sequence
  Description of Artificial Sequence: Synthetic coding sequence
atggccggccacctggccagcgacttcgccttcagccccccccccggcggcggcggcgacggccccggcggccccgagcccggctgggtggaccccagaacctggctgagcttccagggcccccccggcggccccggcatcggccccggcgtgggccccggcagcgaggtgtggggcatccccccctgcccccccccctacgagttctgcggcggcatggcctactgcggcccccaggtgggcgtgggcctggtgccccagggcggcctggagaccagccagcccgagggcgaggccggcgtgggcgtggagagcaacagcgacggcgccagccccgagccctgcaccgtgacccccggcgccgtgaagctggagaaggagaagctggagcagaaccccgaggagagccaggacatcaaggccctgcagaaggagctggagcagttcgccaagctgctgaagcagaagagaatcaccctgggctacacccaggccgacgtgggcctgaccctgggcgtgctgttcggcaaggtgttcagccagaccaccatctgcagattcgaggccctgcagctgagcttcaagaacatgtgcaagctgagacccctgctgcagaagtgggtggaggaggccgacaacaacgagaacctgcaggagatctgcaaggccgagaccctggtgcaggccagaaagagaaagagaaccagcatcgagaacagagtgagaggcaacctggagaacctgttcctgcagtgccccaagcccaccctgcagcagatcagccacatcgcccagcagctgggcctggagaaggacgtggtgagagtgtggttctgcaacagaagacagaagggcaagagaagcagcagcgactacgcccagagagaggacttcgaggccgccggcagccccttcagcggcggccccgtgagcttccccctggcccccggcccccacttcggcacccccggctacggcagcccccacttcaccgccctgtacagcagcgtgcccttccccgagggcgaggccttcccccccgtgagcgtgaccaccctgggcagccccatgcacagcaactag

SEQ ID NO: 2121 - DNA, 798 bp, Artificial Sequence
  Description of Artificial Sequence: Synthetic coding sequence
atgcacttctacagactgttcctgggcgccaccagaagattcctgaaccccgagtggaagggcgagatcgacaactggtgcgtgtacgtgctgaccagcctgctgcccttcaagatccagagccaggacatcaaggccctgcagaaggagctggagcagttcgccaagctgctgaagcagaagagaatcaccctgggctacacccaggccgacgtgggcctgaccctgggcgtgctgttcggcaaggtgttcagccagaccaccatctgcagattcgaggccctgcagctgagcttcaagaacatgtgcaagctgagacccctgctgcagaagtgggtggaggaggccgacaacaacgagaacctgcaggagatctgcaaggccgagaccctggtgcaggccagaaagagaaagagaaccagcatcgagaacagagtgagaggcaacctggagaacctgttcctgcagtgccccaagcccaccctgcagcagatcagccacatcgcccagcagctgggcctggagaaggacgtggtgagagtgtggttctgcaacagaagacagaagggcaagagaagcagcagcgactacgcccagagagaggacttcgaggccgccggcagccccttcagcggcggccccgtgagcttccccctggcccccggcccccacttcggcacccccggctacggcagcccccacttcaccgccctgtacagcagcgtgcccttccccgagggcgaggccttcccccccgtgagcgtgaccaccctgggcagccccatgcacagcaactag

SEQ ID NO: 2122 - DNA, 1083 bp, Artificial Sequence; identical to SEQ ID NO: 2120
  Description of Artificial Sequence: Synthetic coding sequence

SEQ ID NO: 2123 - DNA, 798 bp, Artificial Sequence; identical to SEQ ID NO: 2121
  Description of Artificial Sequence: Synthetic coding sequence

SEQ ID NO: 2124 - DNA, 798 bp, Artificial Sequence; identical to SEQ ID NO: 2121
  Description of Artificial Sequence: Synthetic coding sequence

SEQ ID NO: 2125 - DNA, 1083 bp, Artificial Sequence; identical to SEQ ID NO: 2120
  Description of Artificial Sequence: Synthetic coding sequence

SEQ ID NO: 2126 - DNA, 1083 bp, Artificial Sequence; identical to SEQ ID NO: 2120
  Description of Artificial Sequence: Synthetic coding sequence

SEQ ID NO: 2127 - DNA, 798 bp, Artificial Sequence; identical to SEQ ID NO: 2121
  Description of Artificial Sequence: Synthetic coding sequence

SEQ ID NO: 2128 - DNA, 1083 bp, Artificial Sequence; identical to SEQ ID NO: 2120
  Description of Artificial Sequence: Synthetic coding sequence

SEQ ID NO: 2129 - DNA, 369 bp, Artificial Sequence
  Description of Artificial Sequence: Synthetic coding sequence
atggccggccacctggccagcgacttcgccttcagccccccccccggcggcggcggcgacggccccggcggccccgagcccggctgggtggaccccagaacctggctgagcttccagggcccccccggcggccccggcatcggccccggcgtgggccccggcagcgaggtgtggggcatccccccctgcccccccccctacgagttctgcggcggcatggcctactgcggcccccaggtgggcgtgggcctggtgccccagggcggcctggagaccagccagcccgagggcgaggccggcggcggcgagcagctgagatggggcctgcccggcgccctgcacagacacccctggtgcagagaggcctag

SEQ ID NO: 2130 - DNA, 798 bp, Artificial Sequence; identical to SEQ ID NO: 2121
  Description of Artificial Sequence: Synthetic coding sequence

SEQ ID NO: 2131 - DNA, 1083 bp, Artificial Sequence; identical to SEQ ID NO: 2120
  Description of Artificial Sequence: Synthetic coding sequence

SEQ ID NO: 2132 - DNA, 372 bp, Artificial Sequence
  Description of Artificial Sequence: Synthetic coding sequence
atggccggccacctggccagcgacttcgccttcagccccccccccggcggcggcggcgacggccccggcggccccgagcccggctgggtggaccccagaacctggctgagcttccagggcccccccggcggccccggcatcggccccggcgtgggccccggcagcgaggtgtggggcatccccccctgcccccccccctacgagttctgcggcggcatggcctactgcggcccccaggtgggcgtgggcctggtgccccagggcggcctggagaccagccagcccgagggcgaggccggcgtgggcgtggagacccccatgggcccccccagaagccccgccccccaccccttccccttccccctgctgtag

SEQ ID NO: 2133 - DNA, 558 bp, Artificial Sequence
  Description of Artificial Sequence: Synthetic coding sequence
atggccggccacctggccagcgacttcgccttcagccccccccccggcggcggcggcgacggccccggcggccccgagcccggctgggtggaccccagaacctggctgagcttccagggcccccccggcggccccggcatcggccccggcgtgggccccggcagcgaggtgtggggcatccccccctgcccccccccctacgagttctgcggcggcatggcctactgcggcccccaggtgggcgtgggcctggtgccccagggcggcctggagaccagccagcccgagggcgaggccggcgtgggcgtggagagcaacagcgacggcgccagccccgagccctgcaccgtgacccccggcgccgtgaagctggagaaggagaagctggagcagaaccccgaggagagccaggacatcaaggccctgcagaaggagctggagcagttcgccaagctgctgaagcagaagagaatcaccctgggctacacccaggccgacgtgcaccccggcggcagcatctgggagggcatccagcccaacgaccacctgcccctgtag

SEQ ID NO: 2134 - DNA, 372 bp, Artificial Sequence; identical to SEQ ID NO: 2132
  Description of Artificial Sequence: Synthetic coding sequence

SEQ ID NO: 2135 - DNA, 558 bp, Artificial Sequence; identical to SEQ ID NO: 2133
  Description of Artificial Sequence: Synthetic coding sequence

SEQ ID NO: 2136 - DNA, 372 bp, Artificial Sequence; identical to SEQ ID NO: 2132
  Description of Artificial Sequence: Synthetic coding sequence

SEQ ID NO: 2137 - DNA, 558 bp, Artificial Sequence; identical to SEQ ID NO: 2133
  Description of Artificial Sequence: Synthetic coding sequence

SEQ ID NO: 2138 - DNA, 558 bp, Artificial Sequence; identical to SEQ ID NO: 2133
  Description of Artificial Sequence: Synthetic coding sequence

SEQ ID NO: 2139 - DNA, 372 bp, Artificial Sequence; identical to SEQ ID NO: 2132
  Description of Artificial Sequence: Synthetic coding sequence

SEQ ID NO: 2140 - DNA, 372 bp, Artificial Sequence; identical to SEQ ID NO: 2132
  Description of Artificial Sequence: Synthetic coding sequence

SEQ ID NO: 2141 - DNA, 2079 bp, Artificial Sequence
  Description of Artificial Sequence: Synthetic coding sequence
atgggcaccgtgagcagcagaagaagctggtggcccctgcccctgctgctgctgctgctgctgctgctgggccccgccggcgccagagcccaggaggacgaggacggcgactacgaggagctggtgctggccctgagaagcgaggaggacggcctggccgaggcccccgagcacggcaccaccgccaccttccacagatgcgccaaggacccctggagactgcccggcacctacgtggtggtgctgaaggaggagacccacctgagccagagcgagagaaccgccagaagactgcaggcccaggccgccagaagaggctacctgaccaagatcctgcacgtgttccacggcctgctgcccggcttcctggtgaagatgagcggcgacctgctggagctggccctgaagctgccccacgtggactacatcgaggaggacagcagcgtgttcgcccagagcatcccctggaacctggagagaatcaccccccccagatacagagccgacgagtaccagccccccgacggcggcagcctggtggaggtgtacctgctggacaccagcatccagagcgaccacagagagatcgagggcagagtgatggtgaccgacttcgagaacgtgcccgaggaggacggcaccagattccacagacaggccagcaagtgcgacagccacggcacccacctggccggcgtggtgagcggcagagacgccggcgtggccaagggcgccagcatgagaagcctgagagtgctgaactgccagggcaagggcaccgtgagcggcaccctgatcggcctggagttcatcagaaagagccagctggtgcagcccgtgggccccctggtggtgctgctgcccctggccggcggctacagcagagtgctgaacgccgcctgccagagactggccagagccggcgtggtgctggtgaccgccgccggcaacttcagagacgacgcctgcctgtacagccccgccagcgcccccgaggtgatcaccgtgggcgccaccaacgcccaggaccagcccgtgaccctgggcaccctgggcaccaacttcggcagatgcgtggacctgttcgcccccggcgaggacatcatcggcgccagcagcgactgcagcacctgcttcgtgagccagagcggcaccagccaggccgccgcccacgtggccggcatcgccgccatgatgctgagcgccgagcccgagctgaccctggccgagctgagacagagactgatccacttcagcgccaaggacgtgatcaacgaggcctggttccccgaggaccagagagtgctgacccccaacctggtggccgccctgccccccagcacccacggcgccggctggcagctgttctgcagaaccgtgtggagcgcccacagcggccccaccagaatggccaccgccgtggccagatgcgcccccgacgaggagctgctgagctgcagcagcttcagcagaagcggcaagagaagaggcgagagaatggaggcccagggcggcaagctggtgtgcagagcccacaacgccttcggcggcgagggcgtgtacgccatcgccagatgctgcctgctgccccaggccaactgcagcgtgcacaccgccccccccgccgaggccagcatgggcaccagagtgcactgccaccagcagggccacgtgctgaccggctgcagcagccactgggaggtggaggacctgggcacccacaagccccccgtgctgagacccagaggccagcccaaccagtgcgtgggccacagagaggccagcatccacgccagctgctgccacgcccccggcctggagtgcaaggtgaaggagcacggcatccccgccccccaggagcaggtgaccgtggcctgcgaggagggctggaccctgaccggctgcagcgccctgcccggcaccagccacgtgctgggcgcctacgccgtggacaacacctgcgtggtgagaagcagagacgtgagcaccaccggcagcaccagcgagggcgccgtgaccgccgtggccatctgctgcagaagcagacacctggcccaggccagccaggagctgcagtag

SEQ ID NO: 2142 - DNA, 618 bp, Artificial Sequence
  Description of Artificial Sequence: Synthetic coding sequence
atgggcaccgtgagcagcagaagaagctggtggcccctgcccctgctgctgctgctgctgctgctgctgggccccgccggcgccagagcccaggaggacgaggacggcgactacgaggagctggtgctggccctgagaagcgaggaggacggcctggccgaggcccccgagcacggcaccaccgccaccttccacagatgcgccaaggacccctggagactgcccggcacctacgtggtggtgctgaaggaggagacccacctgagccagagcgagagaaccgccagaagactgcaggcccaggccgccagaagaggctacctgaccaagatcctgcacgtgttccacggcctgctgcccggcttcctggtgaagatgagcggcgacctgctggagctggccctgaagctgccccacgtggactacatcgaggaggacagcagcgtgttcgcccagagcatcccctggaacctggagagaatcaccccccccagatacagagccgacgagtaccagccccccgcctacctggaggaccactgcggcggccacagaggcgccgtgcagatggccctgcagaagacccaggagaccctgggccaggagcagttcgactag

SEQ ID NO: 2143 - DNA, 801 bp, Artificial Sequence
  Description of Artificial Sequence: Synthetic coding sequence
atggtgaccgacttcgagaacgtgcccgaggaggacggcaccagattccacagacaggccagcaagtgcgacagccacggcacccacctggccggcgtggtgagcggcagagacgccggcgtggccaagggcgccagcatgagaagcctgagagtgctgaactgccagggcaagggcaccgtgagcggcaccctgatcggcctggagttcatcagaaagagccagctggtgcagcccgtgggccccctggtggtgctgctgcccctggccggcggctacagcagagtgctgaacgccgcctgccagagactggccagagccggcgtggtgctggtgaccgccgccggcaacttcagagacgacgcctgcctgtacagccccgccagcgcccccgaggtgatcaccgtgggcgccaccaacgcccaggaccagcccgtgaccctgggcaccctgggcaccaacttcggcagatgcgtggacctgttcgcccccggcgaggacatcatcggcgccagcagcgactgcagcacctgcttcgtgagccagagcggcaccagccaggccgccgcccacgtggccggcatcgccgccatgatgctgagcgccgagcccgagctgaccctggccgagctgagacagagactgatccacttcagcgccaaggacgtgatcaacgaggcctggttccccgaggaccagagagtgggcagctgcttcgccggcctgtacggccagcacaccagaggcctgcacggctggccccagcccagccccgccgccccccagatgagaagctgctag

SEQ ID NO: 2144 - DNA, 3972 bp, Artificial Sequence
  Description of Artificial Sequence: Synthetic coding sequence
atggaggacggcggcctgaccgccttcgaggaggaccagagatgcctgagccagagcctgcccctgcccgtgagcgccgagggccccgccgcccagaccaccgccgagcccagcagaagcttcagcagcgcccacagacacctgagcagaagaaacggcctgagcagactgtgccagagcagaaccgccctgagcgaggacagatggagcagctactgcctgagcagcctggccgcccagaacatctgcaccagcaagctgcactgccccgccgcccccgagcacaccgaccccagcgagcccagaggcagcgtgagctgctgcagcctgctgagaggcctgagcagcggctggagcagccccctgctgcccgcccccgtgtgcaaccccaacaaggccatcttcaccgtggacgccaagaccaccgagatcctggtggccaacgacaaggcctgcggcctgctgggctacagcagccaggacctgatcggccagaagctgacccagttcttcctgagaagcgacagcgacgtggtggaggccctgagcgaggagcacatggaggccgacggccacgccgccgtggtgttcggcaccgtggtggacatcatcagcagaagcggcgagaagatccccgtgagcgtgtggatgaagagaatgagacaggagagaagactgtgctgcgtggtggtgctggagcccgtggagagagtgagcacctgggtggccttccagagcgacggcaccgtgaccagctgcgacagcctgttcgcccacctgcacggctacgtgagcggcgaggacgtggccggccagcacatcaccgacctgatccccagcgtgcagctgccccccagcggccagcacatccccaagaacctgaagatccagagaagcgtgggcagagccagagacggcaccaccttccccctgagcctgaagctgaagagccagcccagcagcgaggaggccaccaccggcgaggccgcccccgtgagcggctacagagccagcgtgtgggtgttctgcaccatcagcggcctgatcaccctgctgcccgacggcaccatccacggcatcaaccacagcttcgccctgaccctgttcggctacggcaagaccgagctgctgggcaagaacatcaccttcctgatccccggcttctacagctacatggacctggcctacaacagcagcctgcagctgcccgacctggccagctgcctggacgtgggcaacgagagcggctgcggcgagagaaccctggacccctggcagggccaggaccccgccgagggcggccaggaccccagaatcaacgtggtgctggccggcggccacgtggtgcccagagacgagatcagaaagctgatggagagccaggacatcttcaccggcacccagaccgagctgatcgccggcggccagctgctgagctgcctgagcccccagcccgcccccggcgtggacaacgtgcccgagggcagcctgcccgtgcacggcgagcaggccctgcccaaggaccagcagatcaccgccctgggcagagaggagcccgtggccatcgagagccccggccaggacctgctgggcgagagcagaagcgagcccgtggacgtgaagcccttcgccagctgcgaggacagcgaggcccccgtgcccgccgaggacggcggcagcgacgccggcatgtgcggcctgtgccagaaggcccagctggagagaatgggcgtgagcggccccagcggcagcgacctgtgggccggcgccgccgtggccaagccccaggccaagggccagctggccggcggcagcctgctgatgcactgcccctgctacggcagcgagtggggcctgtggtggagaagccaggacctggcccccagccccagcggcatggccggcctgagcttcggcacccccaccctggacgagccctggctgggcgtggagaacgacagagaggagctgcagacctgcctgatcaaggagcagctgagccagctgagcctggccggcgccctggacgtgccccacgccgagctggtgcccaccgagtgccaggccgtgaccgcccccgtgagcagctgcgacctgggcggcagagacctgtgcggcggctgcaccggcagcagcagcgcctgctacgccctggccaccgacctgcccggcggcctggaggccgtggaggcccaggaggtggacgtgaacagcttcagctggaacctgaaggagctgttcttcagcgaccagaccgaccagaccagcagcaactgcagctgcgccaccagcgagctgagagagacccccagcagcctggccgtgggcagcgaccccgacgtgggcagcctgcaggagcagggcagctgcgtgctggacgacagagagctgctgctgctgaccggcacctgcgtggacctgggccagggcagaagattcagagagagctgcgtgggccacgaccccaccgagcccctggaggtgtgcctggtgagcagcgagcactacgccgccagcgacagagagagccccggccacgtgcccagcaccctggacgccggccccgaggacacctgccccagcgccgaggagcccagactgaacgtgcaggtgaccagcacccccgtgatcgtgatgagaggcgccgccggcctgcagagagagatccaggagggcgcctacagcggcagctgctaccacagagacggcctgagactgagcatccagttcgaggtgagaagagtggagctgcagggccccacccccctgttctgctgctggctggtgaaggacctgctgcacagccagagagacagcgccgccagaaccagactgttcctggccagcctgcccggcagcacccacagcaccgccgccgagctgaccggccccagcctggtggaggtgctgagagccagaccctggttcgaggagccccccaaggccgtggagctggagggcctggccgcctgcgagggcgagtacagccagaagtacagcaccatgagccccctgggcagcggcgccttcggcttcgtgtggaccgccgtggacaaggagaagaacaaggaggtggtggtgaagttcatcaagaaggagaaggtgctggaggactgctggatcgaggaccccaagctgggcaaggtgaccctggagatcgccatcctgagcagagtggagcacgccaacatcatcaaggtgctggacatcttcgagaaccagggcttcttccagctggtgatggagaagcacggcagcggcctggacctgttcgccttcatcgacagacaccccagactggacgagcccctggccagctacatcttcagacagctggtgagcgccgtgggctacctgagactgaaggacatcatccacagagacatcaaggacgagaacatcgtgatcgccgaggacttcaccatcaagctgatcgacttcggcagcgccgcctacctggagagaggcaagctgttctacaccttctgcggcaccatcgagtactgcgcccccgaggtgctgatgggcaacccctacagaggccccgagctggagatgtggagcctgggcgtgaccctgtacaccctggtgttcgaggagaaccccttctgcgagctggaggagaccgtggaggccgccatccaccccccctacctggtgagcaaggagctgatgagcctggtgagcggcctgctgcagcccgtgcccgagagaagaaccaccctggagaagctggtgaccgacccctgggtgacccagcccgtgaacctggccgactacacctgggaggaggtgttcagagtgaacaagcccgagagcggcgtgctgagcgccgccagcctggagatgggcaacagaagcctgagcgacgtggcccaggcccaggagctgtgcggcggccccgtgcccggcgaggcccccaacggccagggctgcctgcaccccggcgaccccagactgctgaccagctag

SEQ ID NO: 2145 - DNA, 1488 bp, Artificial Sequence
  Description of Artificial Sequence: Synthetic coding sequence
atgtggcagctgaccagcctgctgctgttcgtggccacctggggcatcagcggcacccccgcccccctggacagcgtgttcagcagcagcgagagagcccaccaggtgctgagaatcagaaagagagccaacagcttcctggaggagctgagacacagcagcctggagagagagtgcatcgaggagatctgcgacttcgaggaggccaaggagatcttccagaacgtggacgacaccctggccttctggagcaagcacgtggacggcgaccagtgcctggtgctgcccctggagcacccctgcgccagcctgtgctgcggccacggcacctgcatcgacggcatcggcagcttcagctgcgactgcagaagcggctgggagggcagattctgccagagaggcgagggcgagagatggatgctggccggcggcggcgccggcctgggccccggctggggcagaggcaccagcaccagctgccccagaccccccctgcccgccgaggtgagcttcctgaactgcagcctggacaacggcggctgcacccactactgcctggaggaggtgggctggagaagatgcagctgcgcccccggctacaagctgggcgacgacctgctgcagtgccaccccgccgtgaagttcccctgcggcagaccctggaagagaatggagaagaagagaagccacctgaagagagacaccgaggaccaggaggaccaggtggaccccagactgatcgacggcaagatgaccagaagaggcgacagcccctggcaggtggtgctgctggacagcaagaagaagctggcctgcggcgccgtgctgatccaccccagctgggtgctgaccgccgcccactgcatggacgagagcaagaagctgctggtgagactgggcgagtacgacctgagaagatgggagaagtgggagctggacctggacatcaaggaggtgttcgtgcaccccaactacagcaagagcaccaccgacaacgacatcgccctgctgcacctggcccagcccgccaccctgagccagaccatcgtgcccatctgcctgcccgacagcggcctggccgagagagagctgaaccaggccggccaggagaccctggtgaccggctggggctaccacagcagcagagagaaggaggccaagagaaacagaaccttcgtgctgaacttcatcaagatccccgtggtgccccacaacgagtgcagcgaggtgatgagcaacatggtgagcgagaacatgctgtgcgccggcatcctgggcgacagacaggacgcctgcgagggcgacagcggcggccccatggtggccagcttccacggcacctggttcctggtgggcctggtgagctggggcgagggctgcggcctgctgcacaactacggcgtgtacaccaaggtgagcagatacctggactggatccacggccacatcagagacaaggaggccccccagaagagctgggccccctag

SEQ ID NO: 2146 - DNA, 1386 bp, Artificial Sequence
  Description of Artificial Sequence: Synthetic coding sequence
atgtggcagctgaccagcctgctgctgttcgtggccacctggggcatcagcggcacccccgcccccctggacagcgtgttcagcagcagcgagagagcccaccaggtgctgagaatcagaaagagagccaacagcttcctggaggagctgagacacagcagcctggagagagagtgcatcgaggagatctgcgacttcgaggaggccaaggagatcttccagaacgtggacgacaccctggccttctggagcaagcacgtggacggcgaccagtgcctggtgctgcccctggagcacccctgcgccagcctgtgctgcggccacggcacctgcatcgacggcatcggcagcttcagctgcgactgcagaagcggctgggagggcagattctgccagagagaggtgagcttcctgaactgcagcctggacaacggcggctgcacccactactgcctggaggaggtgggctggagaagatgcagctgcgcccccggctacaagctgggcgacgacctgctgcagtgccaccccgccgtgaagttcccctgcggcagaccctggaagagaatggagaagaagagaagccacctgaagagagacaccgaggaccaggaggaccaggtggaccccagactgatcgacggcaagatgaccagaagaggcgacagcccctggcaggtggtgctgctggacagcaagaagaagctggcctgcggcgccgtgctgatccaccccagctgggtgctgaccgccgcccactgcatggacgagagcaagaagctgctggtgagactgggcgagtacgacctgagaagatgggagaagtgggagctggacctggacatcaaggaggtgttcgtgcaccccaactacagcaagagcaccaccgacaacgacatcgccctgctgcacctggcccagcccgccaccctgagccagaccatcgtgcccatctgcctgcccgacagcggcctggccgagagagagctgaaccaggccggccaggagaccctggtgaccggctggggctaccacagcagcagagagaaggaggccaagagaaacagaaccttcgtgctgaacttcatcaagatccccgtggtgccccacaacgagtgcagcgaggtgatgagcaacatggtgagcgagaacatgctgtgcgccggcatcctgggcgacagacaggacgcctgcgagggcgacagcggcggccccatggtggccagcttccacggcacctggttcctggtgggcctggtgagctggggcgagggctgcggcctgctgcacaactacggcgtgtacaccaaggtgagcagatacctggactggatccacggccacatcagagacaaggaggccccccagaagagctgggccccctag

SEQ ID NO: 2147 - DNA, 351 bp, Artificial Sequence
  Description of Artificial Sequence: Synthetic coding sequence
atgtggcagctgaccagcctgctgctgttcgtggccacctggggcatcagcggcacccccgcccccctggacagcgtgttcagcagcagcgagagagcccaccaggtgctgagaatcagaaagagagccaacagcttcctggaggagctgagacacagcagcctggagagagagtgcatcgaggagatctgcgacttcgaggaggccaaggagatcttccagaacgtggacgacaccctggccttctggagcaagcacgtggacggcgaccagtgcctggtgctgcccctggagcacccctgcgccagcctgtgctgcggccacggcacctgcatcgacggcatcggctag

SEQ ID NO: 2148 - DNA, 381 bp, Artificial Sequence
  Description of Artificial Sequence: Synthetic coding sequence
atgtggcagctgaccagcctgctgctgttcgtggccacctggggcatcagcggcacccccgcccccctggacagcgtgttcagcagcagcgagagagcccaccaggtgctgagaatcagaaagagagccaacagcttcctggaggagctgagacacagcagcctggagagagagtgcatcgaggagatctgcgacttcgaggaggccaaggagatcttccagaacgtggacgacaccctggccttctggagcaagcacgtggacggcgaccagtgcctggtgctgcccctggagcacccctgcgccagcctgtgctgcggccacggcacctgcatcgacggcatcggcagcttcagctgcgactgcagaagcggctggtag

SEQ ID NO: 2149 - DNA, 1551 bp, Artificial Sequence
  Description of Artificial Sequence: Synthetic coding sequence
atggccgccggcagaagaacctgcagcatcagcaccaccagaccctgcgccagcgccagcagaatgtggcagctgaccagcctgctgctgttcgtggccacctggggcatcagcggcacccccgcccccctggacagcgtgttcagcagcagcgagagagcccaccaggtgctgagaatcagaaagagagccaacagcttcctggaggagctgagacacagcagcctggagagagagtgcatcgaggagatctgcgacttcgaggaggccaaggagatcttccagaacgtggacgacaccctggccttctggagcaagcacgtggacggcgaccagtgcctggtgctgcccctggagcacccctgcgccagcctgtgctgcggccacggcacctgcatcgacggcatcggcagcttcagctgcgactgcagaagcggctgggagggcagattctgccagagaggcgagggcgagagatggatgctggccggcggcggcgccggcctgggccccggctggggcagaggcaccagcaccagctgccccagaccccccctgcccgccgaggtgagcttcctgaactgcagcctggacaacggcggctgcacccactactgcctggaggaggtgggctggagaagatgcagctgcgcccccggctacaagctgggcgacgacctgctgcagtgccaccccgccgtgaagttcccctgcggcagaccctggaagagaatggagaagaagagaagccacctgaagagagacaccgaggaccaggaggaccaggtggaccccagactgatcgacggcaagatgaccagaagaggcgacagcccctggcaggtggtgctgctggacagcaagaagaagctggcctgcggcgccgtgctgatccaccccagctgggtgctgaccgccgcccactgcatggacgagagcaagaagctgctggtgagactgggcgagtacgacctgagaagatgggagaagtgggagctggacctggacatcaaggaggtgttcgtgcaccccaactacagcaagagcaccaccgacaacgacatcgccctgctgcacctggcccagcccgccaccctgagccagaccatcgtgcccatctgcctgcccgacagcggcctggccgagagagagctgaaccaggccggccaggagaccctggtgaccggctggggctaccacagcagcagagagaaggaggccaagagaaacagaaccttcgtgctgaacttcatcaagatccccgtggtgccccacaacgagtgcagcgaggtgatgagcaacatggtgagcgagaacatgctgtgcgccggcatcctgggcgacagacaggacgcctgcgagggcgacagcggcggccccatggtggccagcttccacggcacctggttcctggtgggcctggtgagctggggcgagggctgcggcctgctgcacaactacggcgtgtacaccaaggtgagcagatacctggactggatccacggccacatcagagacaaggaggccccccagaagagctgggccccctag

SEQ ID NO: 2150 - DNA, 1263 bp, Artificial Sequence
  Description of Artificial Sequence: Synthetic coding sequence
atgtggatgacccactggcccagcggccccagcaccagcaccgtgaccagcgcctggagctgcccctggagcaccagagcccccgcctgcgccgccggcaccgccagagccagcaccgccagcgccgccagcgccgccaccgccgccgccgccggcagagccgccagcgccagcgccgtgagaggcagaggcggctgctggagaggcggcgccggcctgggccccggctggggcagaggcaccagcaccagctgccccagaccccccctgcccgccgaggtgagcttcctgaactgcagcctggacaacggcggctgcacccactactgcctggaggaggtgggctggagaagatgcagctgcgcccccggctacaagctgggcgacgacctgctgcagtgccaccccgccgtgaagttcccctgcggcagaccctggaagagaatggagaagaagagaagccacctgaagagagacaccgaggaccaggaggaccaggtggaccccagactgatcgacggcaagatgaccagaagaggcgacagcccctggcaggtggtgctgctggacagcaagaagaagctggcctgcggcgccgtgctgatccaccccagctgggtgctgaccgccgcccactgcatggacgagagcaagaagctgctggtgagactgggcgagtacgacctgagaagatgggagaagtgggagctggacctggacatcaaggaggtgttcgtgcaccccaactacagcaagagcaccaccgacaacgacatcgccctgctgcacctggcccagcccgccaccctgagccagaccatcgtgcccatctgcctgcccgacagcggcctggccgagagagagctgaaccaggccggccaggagaccctggtgaccggctggggctaccacagcagcagagagaaggaggccaagagaaacagaaccttcgtgctgaacttcatcaagatccccgtggtgccccacaacgagtgcagcgaggtgatgagcaacatggtgagcgagaacatgctgtgcgccggcatcctgggcgacagacaggacgcctgcgagggcgacagcggcggccccatggtggccagcttccacggcacctggttcctggtgggcctggtgagctggggcgagggctgcggcctgctgcacaactacggcgtgtacaccaaggtgagcagatacctggactggatccacggccacatcagagacaaggaggccccccagaagagctgggccccctag

SEQ ID NO: 2151 - DNA, 354 bp, Artificial Sequence
  Description of Artificial Sequence: Synthetic coding sequence
atgcccagactgttcttcttccacctgctgggcgtgtgcctgctgctgaaccagttcagcagagccgtggccgacagctggatggaggaggtgatcaagctgtgcggcagagagctggtgagagcccagatcgccatctgcggcatgagcacctggagcaagagaagcctgagccaggaggacgccccccagacccccagacccgtggccggcgacttcatccagaccgtgagcctgggcatcagccccgacggcggcaaggccctgagaaccggcagctgcttcaccagagagttcctgggcgccctgagcaagctgtgccaccccagcagcaccaagatccagaagccctag

SEQ ID NO: 2152 - DNA, 558 bp, Artificial Sequence
  Description of Artificial Sequence: Synthetic coding sequence
atgcccagactgttcttcttccacctgctgggcgtgtgcctgctgctgaaccagttcagcagagccgtggccgacagctggatggaggaggtgatcaagctgtgcggcagagagctggtgagagcccagatcgccatctgcggcatgagcacctggagcaagagaagcctgagccaggaggacgccccccagacccccagacccgtggccgagatcgtgcccagcttcatcaacaaggacaccgagaccatcaacatgatgagcgagttcgtggccaacctgccccaggagctgaagctgaccctgagcgagatgcagcccgccctgccccagctgcagcagcacgtgcccgtgctgaaggacagcagcctgctgttcgaggagttcaagaagctgatcagaaacagacagagcgaggccgccgacagcagccccagcgagctgaagtacctgggcctggacacccacagcagaaagaagagacagctgtacagcgccctggccaacaagtgctgccacgtgggctgcaccaagagaagcctggccagattctgctag

SEQ ID NO: 2153 - DNA, 1047 bp, Artificial Sequence
  Description of Artificial Sequence: Synthetic coding sequence
atgaacggcaccgagggccccaacttctacgtgcccttcagcaacgccaccggcgtggtgagaagccccttcgagtacccccagtactacctggccgagccctggcagttcagcatgctggccgcctacatgttcctgctgatcgtgctgggcttccccatcaacttcctgaccctgtacgtgaccgtgcagcacaagaagctgagaacccccctgaactacatcctgctgaacctggccgtggccgacctgttcatggtgctgggcggcttcaccagcaccctgtacaccagcctgcacggctacttcgtgttcggccccaccggctgcaacctggagggcttcttcgccaccctgggcggcgagatcgccctgtggagcctggtggtgctggccatcgagagatacgtggtggtgtgcaagcccatgagcaacttcagattcggcgagaaccacgccatcatgggcgtggccttcacctgggtgatggccctggcctgcgccgccccccccctggccggctggagcagatacatccccgagggcctgcagtgcagctgcggcatcgactactacaccctgaagcccgaggtgaacaacgagagcttcgtgatctacatgttcgtggtgcacttcaccatccccatgatcatcatcttcttctgctacggccagctggtgttcaccgtgaaggaggccgccgcccagcagcaggagagcgccaccacccagaaggccgagaaggaggtgaccagaatggtgatcatcatggtgatcgccttcctgatctgctgggtgccctacgccagcgtggccttctacatcttcacccaccagggcagcaacttcggccccatcttcatgaccatccccgccttcttcgccaagagcgccgccatctacaaccccgtgatctacatcatgatgaacaagcagttcagaaactgcatgctgaccaccatctgctgcggcaagaaccccctgggcgacgacgaggccagcgccaccgtgagcaagaccgagaccagccaggtggcccccgcctag

SEQ ID NO: 2154 - DNA, 1257 bp, Artificial Sequence
  Description of Artificial Sequence: Synthetic coding sequence
atgcccagcagcgtgagctggggcatcctgctgctggccggcctgtgctgcctggtgcccgtgagcctggccgaggacccccagggcgacgccgcccagaagaccgacaccagccaccacgaccaggaccaccccaccttcaacaagatcacccccaacctggccgagttcgccttcagcctgtacagacagctggcccaccagagcaacagcaccaacatcttcttcagccccgtgagcatcgccaccgccttcgccatgctgagcctgggcaccaaggccgacacccacgacgagatcctggagggcctgaacttcaacctgaccgagatccccgaggcccagatccacgagggcttccaggagctgctgagaaccctgaaccagcccgacagccagctgcagctgaccaccggcaacggcctgttcctgagcgagggcctgaagctggtggacaagttcctggaggacgtgaagaagctgtaccacagcgaggccttcaccgtgaacttcggcgacaccgaggaggccaagaagcagatcaacgactacgtggagaagggcacccagggcaagatcgtggacctggtgaaggagctggacagagacaccgtgttcgccctggtgaactacatcttcttcaagggcaagtgggagagacccttcgaggtgaaggacaccgaggaggaggacttccacgtggaccaggtgaccaccgtgaaggtgcccatgatgaagagactgggcatgttcaacatccagcactgcaagaagctgagcagctgggtgctgctgatgaagtacctgggcaacgccaccgccatcttcttcctgcccgacgagggcaagctgcagcacctggagaacgagctgacccacgacatcatcaccaagttcctggagaacgaggacagaagaagcgccagcctgcacctgcccaagctgagcatcaccggcacctacgacctgaagagcgtgctgggccagctgggcatcaccaaggtgttcagcaacggcgccgacctgagcggcgtgaccgaggaggcccccctgaagctgagcaaggccgtgcacaaggccgtgctgaccatcgacgagaagggcaccgaggccgccggcgccatgttcctggaggccatccccatgagcatcccccccgaggtgaagttcaacaagcccttcgtgttcctgatgatcgagcagaacaccaagagccccctgttcatgggcaaggtggtgaaccccacccagaagtag

SEQ ID NO: 2155 - DNA, 1257 bp, Artificial Sequence; identical to SEQ ID NO: 2154
  Description of Artificial Sequence: Synthetic coding sequence

SEQ ID NO: 2156 - DNA, 1257 bp, Artificial Sequence; identical to SEQ ID NO: 2154
  Description of Artificial Sequence: Synthetic coding sequence

SEQ ID NO: 2157 - DNA, 1080 bp, Artificial Sequence
  Description of Artificial Sequence: Synthetic coding sequence
atgcccagcagcgtgagctggggcatcctgctgctggccggcctgtgctgcctggtgcccgtgagcctggccgaggacccccagggcgacgccgcccagaagaccgacaccagccaccacgaccaggaccaccccaccttcaacaagatcacccccaacctggccgagttcgccttcagcctgtacagacagctggcccaccagagcaacagcaccaacatcttcttcagccccgtgagcatcgccaccgccttcgccatgctgagcctgggcaccaaggccgacacccacgacgagatcctggagggcctgaacttcaacctgaccgagatccccgaggcccagatccacgagggcttccaggagctgctgagaaccctgaaccagcccgacagccagctgcagctgaccaccggcaacggcctgttcctgagcgagggcctgaagctggtggacaagttcctggaggacgtgaagaagctgtaccacagcgaggccttcaccgtgaacttcggcgacaccgaggaggccaagaagcagatcaacgactacgtggagaagggcacccagggcaagatcgtggacctggtgaaggagctggacagagacaccgtgttcgccctggtgaactacatcttcttcaagggcaagtgggagagacccttcgaggtgaaggacaccgaggaggaggacttccacgtggaccaggtgaccaccgtgaaggtgcccatgatgaagagactgggcatgttcaacatccagcactgcaagaagctgagcagctgggtgctgctgatgaagtacctgggcaacgccaccgccatcttcttcctgcccgacgagggcaagctgcagcacctggagaacgagctgacccacgacatcatcaccaagttcctggagaacgaggacagaagaagcgccagcctgcacctgcccaagctgagcatcaccggcacctacgacctgaagagcgtgctgggccagctgggcatcaccaaggtgttcagcaacggcgccgacctgagcggcgtgaccgaggaggcccccctgaagctgagcaaggtgagaagcccctag

SEQ ID NO: 2158 - DNA, 1257 bp, Artificial Sequence; identical to SEQ ID NO: 2154
  Description of Artificial Sequence: Synthetic coding sequence

SEQ ID NO: 2159 - DNA, 1257 bp, Artificial Sequence; identical to SEQ ID NO: 2154
  Description of Artificial Sequence: Synthetic coding sequence

SEQ ID NO: 2160 - DNA, 1257 bp, Artificial Sequence; identical to SEQ ID NO: 2154
  Description of Artificial Sequence: Synthetic coding sequence

SEQ ID NO: 2161 - DNA, 1257 bp, Artificial Sequence; identical to SEQ ID NO: 2154
  Description of Artificial Sequence: Synthetic coding sequence

SEQ ID NO: 2162 - DNA, 1257 bp, Artificial Sequence; identical to SEQ ID NO: 2154
  Description of Artificial Sequence: Synthetic coding sequence

SEQ ID NO: 2163 - DNA, 279 bp, Artificial Sequence
  Description of Artificial Sequence: Synthetic coding sequence
atgcccagcagcgtgagctggggcatcctgctgctggccggcctgtgctgcctggtgcccgtgagcctggccgaggacccccagggcgacgccgcccagaagaccgacaccagccaccacgaccaggaccaccccaccttcaacaagatcacccccaacctggccgagttcgccttcagcctgtacagacagctggcccaccagagcaacagcaccaacatcttcttcagccccgtgagcatcgccaccgccttcgccatgctgagcctgggcacctag

SEQ ID NO: 2164 - DNA, 471 bp, Artificial Sequence
  Description of Artificial Sequence: Synthetic coding sequence
atgcccagcagcgtgagctggggcatcctgctgctggccggcctgtgctgcctggtgcccgtgagcctggccgaggacccccagggcgacgccgcccagaagaccgacaccagccaccacgaccaggaccaccccaccttcaacaagatcacccccaacctggccgagttcgccttcagcctgtacagacagctggcccaccagagcaacagcaccaacatcttcttcagccccgtgagcatcgccaccgccttcgccatgctgagcctgggcaccaaggccgacacccacgacgagatcctggagggcctgaacttcaacctgaccgagatccccgaggcccagatccacgagggcttccaggagctgctgagaaccctgaaccagcccgacagccagctgcagctgaccaccggcaacggcctgttcctgagcgagggcctgaagctggtggacaagttcctggagtag

SEQ ID NO: 2165 - DNA, 354 bp, Artificial Sequence
  Description of Artificial Sequence: Synthetic coding sequence
atgcccagcagcgtgagctggggcatcctgctgctggccggcctgtgctgcctggtgcccgtgagcctggccgaggacccccagggcgacgccgcccagaagaccgacaccagccaccacgaccaggaccaccccaccttcaacaagatcacccccaacctggccgagttcgccttcagcctgtacagacagctggcccaccagagcaacagcaccaacatcttcttcagccccgtgagcatcgccaccgccttcgccatgctgagcctgggcaccaaggccgacacccacgacgagatcctggagggcctgaacttcaacctgaccgagatccccgaggcccagatccactag

SEQ ID NO: 2166 - DNA, 69 bp, Artificial Sequence
  Description of Artificial Sequence: Synthetic coding sequence
atgcccagcagcgtgagctggggcatcctgctgctggccggcctgtgctgcctggtgcccgtgagctag

SEQ ID NO: 2167 - DNA, 435 bp, Artificial Sequence
  Description of Artificial Sequence: Synthetic coding sequence
atgcccagcagcgtgagctggggcatcctgctgctggccggcctgtgctgcctggtgcccgtgagcctggccgaggacccccagggcgacgccgcccagaagaccgacaccagccaccacgaccaggaccaccccaccttcaacaagatcacccccaacctggccgagttcgccttcagcctgtacagacagctggcccaccagagcaacagcaccaacatcttcttcagccccgtgagcatcgccaccgccttcgccatgctgagcctgggcaccaaggccgacacccacgacgagatcctggagggcctgaacttcaacctgaccgagatccccgaggcccagatccacgagggcttccaggagctgctgagaaccctgaaccagcccgacagccagctgcagctgaccaccggcaacggcctgttcctgtag

SEQ ID NO: 2168 - DNA, 780 bp, Artificial Sequence
  Description of Artificial Sequence: Synthetic coding sequence
atgtacagcaacgtgatcggcaccgtgaccagcggcaagagaaaggtgtacctgctgagcctgctgctgatcggcttctgggactgcgtgacctgccacggcagccccgtggacatctgcaccgccaagcccagagacatccccatgaaccccatgtgcatctacagaagccccgagaagaaggccaccgaggacgagggcagcgagcagaagatccccgaggccaccaacagaagagtgtgggagctgagcaaggccaacagcagattcgccaccaccttctaccagcacctggccgacagcaagaacgacaacgacaacatcttcctgagccccctgagcatcagcaccgccttcgccatgaccaagctgggcgcctgcaacgacaccctgcagcagctgatggaggtgttcaagttcgacaccatcagcgagaagaccagcgaccagatccacttcttcttcgccaagctgaactgcagactgtacagaaaggccaacaagagcagcaagctggtgagcgccaacagactgttcggcgacaagagcctgaccttcaacgacctgtacgtgagcgacgccttccacaaggccttcctggaggtgaacgaggagggcagcgaggccgccgccagcaccgccgtggtgatcgccggcagaagcctgaaccccaacagagtgaccttcaaggccaacagacccttcctggtgttcatcagagaggtgcccctgaacaccatcatcttcatgggcagagtggccaacccctgcgtgaagtag

SEQ ID NO: 2169 - DNA, 1395 bp, Artificial Sequence
  Description of Artificial Sequence: Synthetic coding sequence
atgtacagcaacgtgatcggcaccgtgaccagcggcaagagaaaggtgtacctgctgagcctgctgctgatcggcttctgggactgcgtgacctgccacggcagccccgtggacatctgcaccgccaagcccagagacatccccatgaaccccatgtgcatctacagaagccccgagaagaaggccaccgaggacgagggcagcgagcagaagatccccgaggccaccaacagaagagtgtgggagctgagcaaggccaacagcagattcgccaccaccttctaccagcacctggccgacagcaagaacgacaacgacaacatcttcctgagccccctgagcatcagcaccgccttcgccatgaccaagctgggcgcctgcaacgacaccctgcagcagctgatggaggtgttcaagttcgacaccatcagcgagaagaccagcgaccagatccacttcttcttcgccaagctgaactgcagactgtacagaaaggccaacaagagcagcaagctggtgagcgccaacagactgttcggcgacaagagcctgaccttcaacgagacctaccaggacatcagcgagctggtgtacggcgccaagctgcagcccctggacttcaaggagaacgccgagcagagcagagccgccatcaacaagtgggtgagcaacaagaccgagggcagaatcaccgacgtgatccccagcgaggccatcaacgagctgaccgtgctggtgctggtgaacaccatctacttcaagggcctgtggaagagcaagttcagccccgagaacaccagaaaggagctgttctacaaggccgacggcgagagctgcagcgccagcatgatgtaccaggagggcaagttcagatacagaagagtggccgagggcacccaggtgctggagctgcccttcaagggcgacgacatcaccatggtgctgatcctgcccaagcccgagaagagcctggccaaggtggagaaggagctgacccccgaggtgctgcaggagtggctggacgagctggaggagatgatgctggtggtgcacatgcccagattcagaatcgaggacggcttcagcctgaaggagcagctgcaggacatgggcctggtggacctgttcagccccgagaagagcaagctgcccggcatcgtggccgagggcagagacgacctgtacgtgagcgacgccttccacaaggccttcctggaggtgaacgaggagggcagcgaggccgccgccagcaccgccgtggtgatcgccggcagaagcctgaaccccaacagagtgaccttcaaggccaacagacccttcctggtgttcatcagagaggtgcccctgaacaccatcatcttcatgggcagagtggccaacccctgcgtgaagtag

SEQ ID NO: 2170 - DNA, 1476 bp, Artificial Sequence
  Description of Artificial Sequence: Synthetic coding sequence
atggccctgctgtggggcctgctggtgctgagctggagctgcctgcagggcccctgcagcgtgttcagccccgtgagcgccatggagcccctgggcagacagctgaccagcggccccaaccaggagcaggtgagccccctgaccctgctgaagctgggcaaccaggagcccggcggccagaccgccctgaagagcccccccggcgtgtgcagcagagaccccacccccgagcagacccacagactggccagagccatgatggccttcaccgccgacctgttcagcctggtggcccagaccagcacctgccccaacctgatcctgagccccctgagcgtggccctggccctgagccacctggccctgggcgcccagaaccacaccctgcagagactgcagcaggtgctgcacgccggcagcggcccctgcctgccccacctgctgagcagactgtgccaggacctgggccccggcgccttcagactggccgccagaatgtacctgcagaagggcttccccatcaaggaggacttcctggagcagagcgagcagctgttcggcgccaagcccgtgagcctgaccggcaagcaggaggacgacctggccaacatcaaccagtgggtgaaggaggccaccgagggcaagatccaggagttcctgagcggcctgcccgaggacaccgtgctgctgctgctgaacgccatccacttccagggcttctggagaaacaagttcgaccccagcctgacccagagagacagcttccacctggacgagcagttcaccgtgcccgtggagatgatgcaggccagaacctaccccctgagatggttcctgctggagcagcccgagatccaggtggcccacttccccttcaagaacaacatgagcttcgtggtgctggtgcccacccacttcgagtggaacgtgagccaggtgctggccaacctgagctgggacaccctgcacccccccctggtgtgggagagacccaccaaggtgagactgcccaagctgtacctgaagcaccagatggacctggtggccaccctgagccagctgggcctgcaggagctgttccaggcccccgacctgagaggcatcagcgagcagagcctggtggtgagcggcgtgcagcaccagagcaccctggagctgagcgaggtgggcgtggaggccgccgccgccaccagcatcgccatgagcagaatgagcctgagcagcttcagcgtgaacagacccttcctgttcttcatcttcgaggacaccaccggcctgcccctgttcgtgggcagcgtgagaaaccccaaccccagcgcccccagagagctgaaggagcagcaggacagccccggcaacaaggacttcctgcagagcctgaagggcttccccagaggcgacaagctgttcggccccgacctgaagctggtgccccccatggaggaggactacccccagttcggcagccccaagtag

SEQ ID NO: 2171 - DNA, 1476 bp, Artificial Sequence; identical to SEQ ID NO: 2170
  Description of Artificial Sequence: Synthetic coding sequence

SEQ ID NO: 2172 - DNA, 1284 bp, Artificial Sequence
  Description of Artificial Sequence: Synthetic coding sequence
atggccctgctgtggggcctgctggtgctgagctggagctgcctgcagggcccctgcagcgtgttcagccccgtgagcgccatggagcccctgggcagacagctgaccagcggccccaaccaggagcaggtgagccccctgaccctgctgaagctgggcaaccaggtgcagcccggcgcccagaaccacaccctgcagagactgcagcaggtgctgcacgccggcagcggcccctgcctgccccacctgctgagcagactgtgccaggacctgggccccggcgccttcagactggccgccagaatgtacctgcagaagggcttccccatcaaggaggacttcctggagcagagcgagcagctgttcggcgccaagcccgtgagcctgaccggcaagcaggaggacgacctggccaacatcaaccagtgggtgaaggaggccaccgagggcaagatccaggagttcctgagcggcctgcccgaggacaccgtgctgctgctgctgaacgccatccacttccagggcttctggagaaacaagttcgaccccagcctgacccagagagacagcttccacctggacgagcagttcaccgtgcccgtggagatgatgcaggccagaacctaccccctgagatggttcctgctggagcagcccgagatccaggtggcccacttccccttcaagaacaacatgagcttcgtggtgctggtgcccacccacttcgagtggaacgtgagccaggtgctggccaacctgagctgggacaccctgcacccccccctggtgtgggagagacccaccaaggtgagactgcccaagctgtacctgaagcaccagatggacctggtggccaccctgagccagctgggcctgcaggagctgttccaggcccccgacctgagaggcatcagcgagcagagcctggtggtgagcggcgtgcagcaccagagcaccctggagctgagcgaggtgggcgtggaggccgccgccgccaccagcatcgccatgagcagaatgagcctgagcagcttcagcgtgaacagacccttcctgttcttcatcttcgaggacaccaccggcctgcccctgttcgtgggcagcgtgagaaaccccaaccccagcgcccccagagagctgaaggagcagcaggacagccccggcaacaaggacttcctgcagagcctgaagggcttccccagaggcgacaagctgttcggccccgacctgaagctggtgccccccatggaggaggactacccccagttcggcagccccaagtag

SEQ ID NO: 2173 - DNA, 768 bp, Artificial Sequence
  Description of Artificial Sequence: Synthetic coding sequence
atggccctgctgtggggcctgctggtgctgagctggagctgcctgcagggcccctgcagcgtgttcagccccgtgagcgccatggagcccctgggcagacagctgaccagcggccccaaccaggagcaggtgagccccctgaccctgctgaagctgggcaaccaggagcccggcggccagaccgccctgaagagcccccccggcgtgtgcagcagagaccccacccccgagcagacccacagactggccagagccatgatggccttcaccgccgacctgttcagcctggtggcccagaccagcacctgccccaacctgatcctgagccccctgagcgtggccctggccctgagccacctggccctgggcgcccagaaccacaccctgcagagactgcagcaggtgctgcacgccggcagcggcccctgcctgccccacctgctgagcagactgtgccaggacctgggccccggcgccttcagactggccgccagaatgtacctgcagaagggcttccccatcaaggaggacttcctggagcagagcgagcagctgttcggcgccaagcccgtgagcctgaccggcaagcaggaggacgacctggccaacatcaaccagtgggtgaaggaggccaccgagggcaagatccaggagttcctgagcggcctgcccgaggacaccgtgctgctgctgctgaacgccatccacttccagggcttctggagaaacaagttcgaccccagcctgacccagagagacagcttctag

SEQ ID NO: 2174 - DNA, 1503 bp, Artificial Sequence
  Description of Artificial Sequence: Synthetic coding sequence
atggccagcagactgaccctgctgaccctgctgctgctgctgctggccggcgacagagccagcagcaaccccaacgccaccagcagcagcagccaggaccccgagagcctgcaggacagaggcgagggcaaggtggccaccaccgtgatcagcaagatgctgttcgtggagcccatcctggaggtgagcagcctgcccaccaccaacagcaccaccaacagcgccaccaagatcaccgccaacaccaccgacgagcccaccacccagcccaccaccgagcccaccacccagcccaccatccagcccacccagcccaccacccagctgcccaccgacagccccacccagcccaccaccggcagcttctgccccggccccgtgaccctgtgcagcgacctggagagccacagcaccgaggccgtgctgggcgacgccctggtggacttcagcctgaagctgtaccacgccttcagcgccatgaagaaggtggagaccaacatggccttcagccccttcagcatcgccagcctgctgacccaggtgctgctgggcgccggcgagaacaccaagaccaacctggagagcatcctgagctaccccaaggacttcacctgcgtgcaccaggccctgaagggcttcaccaccaagggcgtgaccagcgtgagccagatcttccacagccccgacctggccatcagagacaccttcgtgaacgccagcagaaccctgtacagcagcagccccagagtgctgagcaacaacagcgacgccaacctggagctgatcaacacctgggtggccaagaacaccaacaacaagatcagcagactgctggacagcctgcccagcgacaccagactggtgctgctgaacgccatctacctgagcgccaagtggaagaccaccttcgaccccaagaagaccagaatggagcccttccacttcaagaacagcgtgatcaaggtgcccatgatgaacagcaagaagtaccccgtggcccacttcatcgaccagaccctgaaggccaaggtgggccagctgcagctgagccacaacctgagcctggtgatcctggtgccccagaacctgaagcacagactggaggacatggagcaggccctgagccccagcgtgttcaaggccatcatggagaagctggagatgagcaagttccagcccaccctgctgaccctgcccagaatcaaggtgaccaccagccaggacatgctgagcatcatggagaagctggagttcttcgacttcagctacgacctgaacctgtgcggcctgaccgaggaccccgacctgcaggtgagcgccatgcagcaccagaccgtgctggagctgaccgagaccggcgtggaggccgccgccgccagcgccatcagcgtggccagaaccctgctggtgttcgaggtgcagcagcccttcctgttcgtgctgtgggaccagcagcacaagttccccgtgttcatgggcagagtgtacgaccccagagcctag

SEQ ID NO: 2175 - DNA, 1518 bp, Artificial Sequence
  Description of Artificial Sequence: Synthetic coding sequence
atggccagcagactgaccctgctgaccctgctgctgctgctgctggccggcttcctggagccccaggacagagccagcagcaaccccaacgccaccagcagcagcagccaggaccccgagagcctgcaggacagaggcgagggcaaggtggccaccaccgtgatcagcaagatgctgttcgtggagcccatcctggaggtgagcagcctgcccaccaccaacagcaccaccaacagcgccaccaagatcaccgccaacaccaccgacgagcccaccacccagcccaccaccgagcccaccacccagcccaccatccagcccacccagcccaccacccagctgcccaccgacagccccacccagcccaccaccggcagcttctgccccggccccgtgaccctgtgcagcgacctggagagccacagcaccgaggccgtgctgggcgacgccctggtggacttcagcctgaagctgtaccacgccttcagcgccatgaagaaggtggagaccaacatggccttcagccccttcagcatcgccagcctgctgacccaggtgctgctgggcgccggcgagaacaccaagaccaacctggagagcatcctgagctaccccaaggacttcacctgcgtgcaccaggccctgaagggcttcaccaccaagggcgtgaccagcgtgagccagatcttccacagccccgacctggccatcagagacaccttcgtgaacgccagcagaaccctgtacagcagcagccccagagtgctgagcaacaacagcgacgccaacctggagctgatcaacacctgggtggccaagaacaccaacaacaagatcagcagactgctggacagcctgcccagcgacaccagactggtgctgctgaacgccatctacctgagcgccaagtggaagaccaccttcgaccccaagaagaccagaatggagcccttccacttcaagaacagcgtgatcaaggtgcccatgatgaacagcaagaagtaccccgtggcccacttcatcgaccagaccctgaaggccaaggtgggccagctgcagctgagccacaacctgagcctggtgatcctggtgccccagaacctgaagcacagactggaggacatggagcaggccctgagccccagcgtgttcaaggccatcatggagaagctggagatgagcaagttccagcccaccctgctgaccctgcccagaatcaaggtgaccaccagccaggacatgctgagcatcatggagaagctggagttcttcgacttcagctacgacctgaacctgtgcggcctgaccgaggaccccgacctgcaggtgagcgccatgcagcaccagaccgtgctggagctgaccgagaccggcgtggaggccgccgccgccagcgccatcagcgtggccagaaccctgctggtgttcgaggtgcagcagcccttcctgttcgtgctgtgggaccagcagcacaagttccccgtgttcatgggcagagtgtacgaccccagagcctag

SEQ ID NO: 2176 - DNA, 1347 bp, Artificial Sequence
  Description of Artificial Sequence: Synthetic coding sequence
atgctgttcgtggagcccatcctggaggtgagcagcctgcccaccaccaacagcaccaccaacagcgccaccaagatcaccgccaacaccaccgacgagcccaccacccagcccaccaccgagcccaccacccagcccaccatccagcccacccagcccaccacccagctgcccaccgacagccccacccagcccaccaccggcagcttctgccccggccccgtgaccctgtgcagcgacctggagagccacagcaccgaggccgtgctgggcgacgccctggtggacttcagcctgaagctgtaccacgccttcagcgccatgaagaaggtggagaccaacatggccttcagccccttcagcatcgccagcctgctgacccaggtgctgctgggcgccggcgagaacaccaagaccaacctggagagcatcctgagctaccccaaggacttcacctgcgtgcaccaggccctgaagggcttcaccaccaagggcgtgaccagcgtgagccagatcttccacagccccgacctggccatcagagacaccttcgtgaacgccagcagaaccctgtacagcagcagccccagagtgctgagcaacaacagcgacgccaacctggagctgatcaacacctgggtggccaagaacaccaacaacaagatcagcagactgctggacagcctgcccagcgacaccagactggtgctgctgaacgccatctacctgagcgccaagtggaagaccaccttcgaccccaagaagaccagaatggagcccttccacttcaagaacagcgtgatcaaggtgcccatgatgaacagcaagaagtaccccgtggcccacttcatcgaccagaccctgaaggccaaggtgggccagctgcagctgagccacaacctgagcctggtgatcctggtgccccagaacctgaagcacagactggaggacatggagcaggccctgagccccagcgtgttcaaggccatcatggagaagctggagatgagcaagttccagcccaccctgctgaccctgcccagaatcaaggtgaccaccagccaggacatgctgagcatcatggagaagctggagttcttcgacttcagctacgacctgaacctgtgcggcctgaccgaggaccccgacctgcaggtgagcgccatgcagcaccagaccgtgctggagctgaccgagaccggcgtggaggccgccgccgccagcgccatcagcgtggccagaaccctgctggtgttcgaggtgcagcagcccttcctgttcgtgctgtgggaccagcagcacaagttccccgtgttcatgggcagagtgtacgaccccagagcctag

SEQ ID NO: 2177 - DNA, 483 bp, Artificial Sequence
  Description of Artificial Sequence: Synthetic coding sequence
atggccagcagactgaccctgctgaccctgctgctgctgctgctggccggcgacagagccagcagcaaccccaacgccaccagcagcagcagccaggaccccgagagcctgcaggacagaggcgagggcaaggtggccaccaccgtgatcagcaagatgctgttcgtggagcccatcctggaggtgagcagcctgcccaccaccaacagcaccaccaacagcgccaccaagatcaccgccaacaccaccgacgagcccaccacccagcccaccaccgagcccaccacccagcccaccatccagcccacccagcccaccacccagctgcccaccgacagccccacccagcccaccaccggcagcttctgccccggccccgtgaccctgtgcagcgacctggagagccacagcaccgaggccgtgctgggcgacgccctggtggacttcagcctgaagctgtaccacgccttcagcgccatgtag

SEQ ID NO: 2178 - DNA, 402 bp, Artificial Sequence
  Description of Artificial Sequence: Synthetic coding sequence
atggccagcagactgaccctgctgaccctgctgctgctgctgctggccggcgacagagccagcagcaaccccaacgccaccagcagcagcagccaggaccccgagagcctgcaggacagaggcgagggcaaggtggccaccaccgtgatcagcaagatgctgttcgtggagcccatcctggaggtgagcagcctgcccaccaccaacagcaccaccaacagcgccaccaagatcaccgccaacaccaccgacgagcccaccacccagcccaccaccgagcccaccacccagcccaccatccagcccacccagcccaccacccagctgcccaccgacagccccacccagcccggctacgccctgaaccacggcgagatcggcatcctgagattcttcctgtag

SEQ ID NO: 2179 - DNA, 3405 bp, Artificial Sequence
  Description of Artificial Sequence: Synthetic coding sequence
atgcccgtgttccacaccagaaccatcgagagcatcctggagcccgtggcccagcagatcagccacctggtgatcatgcacgaggagggcgaggtggacggcaaggccatccccgacctgaccgcccccgtggccgccgtgcaggccgccgtgagcaacctggtgagagtgggcaaggagaccgtgcagaccaccgaggaccagatcctgaagagagacatgccccccgccttcatcaaggtggagaacgcctgcaccaagctggtgcaggccgcccagatgctgcagagcgacccctacagcgtgcccgccagagactacctgatcgacggcagcagaggcatcctgagcggcaccagcgacctgctgctgaccttcgacgaggccgaggtgagaaagatcatcagagtgtgcaagggcatcctggagtacctgaccgtggccgaggtggtggagaccatggaggacctggtgacctacaccaagaacctgggccccggcatgaccaagatggccaagatgatcgacgagagacagcaggagctgacccaccaggagcacagagtgatgctggtgaacagcatgaacaccgtgaaggagctgctgcccgtgctgatcagcgccatgaagatcttcgtgaccaccaagaacagcaagaaccagggcatcgaggaggccctgaagaacagaaacttcaccgtggagaagatgagcgccgagatcaacgagatcatcagagtgctgcagctgaccagctgggacgaggacgcctgggccagcaaggacaccgaggccatgaagagagccctggccagcatcgacagcaagctgaaccaggccaagggctggctgagagaccccagcgccagccccggcgacgccggcgagcaggccatcagacagatcctggacgaggccggcaaggtgggcgagctgtgcgccggcaaggagagaagagagatcctgggcacctgcaagatgctgggccagatgaccgaccaggtggccgacctgagagccagaggccagggcagcagccccgtggccatgcagaaggcccagcaggtgagccagggcctggacgtgctgaccgccaaggtggagaacgccgccagaaagctggaggccatgaccaacagcaagcagagcatcgccaagaagatcgacgccgcccagaactggctggccgaccccaacggcggccccgagggcgaggagcagatcagaggcgccctggccgaggccagaaagatcgccgagctgtgcgacgaccccaaggagagagacgacatcctgagaagcctgggcgagatcagcgccctgaccagcaagctggccgacctgagaagacagggcaagggcgacagccccgaggccagagccctggccaagcaggtggccaccgccctgcagaacctgcagaccaagaccaacagagccgtggccaacagcagacccgccaaggccgccgtgcacctggagggcaagatcgagcaggcccagagatggatcgacaaccccaccgtggacgacagaggcgtgggccaggccgccatcagaggcctggtggccgagggccacagactggccaacgtgatgatgggcccctacagacaggacctgctggccaagtgcgacagagtggaccagctgaccgcccagctggccgacctggccgccagaggcgagggcgagagcccccaggccagagccctggccagccagctgcaggacagcctgaaggacctgaaggccagaatgcaggaggccatgacccaggaggtgagcgacgtgttcagcgacaccaccacccccatcaagctgctggccgtggccgccaccgccccccccgacgcccccaacagagaggaggtgttcgacgagagagccgccaacttcgagaaccacagcggcaagctgggcgccaccgccgagaaggccgccgccgtgggcaccgccaacaagagcaccgtggagggcatccaggccagcgtgaagaccgccagagagctgaccccccaggtggtgagcgccgccagaatcctgctgagaaaccccggcaaccaggccgcctacgagcacttcgagaccatgaagaaccagtggatcgacaacgtggagaagatgaccggcctggtggacgaggccatcgacaccaagagcctgctggacgccagcgaggaggccatcaagaaggacctggacaagtgcaaggtggccatggccaacatccagccccagatgctggtggccggcgccaccagcatcgccagaagagccaacagaatcctgctggtggccaagagagaggtggagaacagcgaggaccccaagttcagagaggccgtgaaggccgccagcgacgagctgagcaagaccatcagccccatggtgatggacgccaaggccgtggccggcaacatcagcgaccccggcctgcagaagagcttcctggacagcggctacagaatcctgggcgccgtggccaaggtgagagaggccttccagccccaggagcccgacttccccccccccccccccgacctggagcagctgagactgaccgacgagctggccccccccaagccccccctgcccgagggcgaggtgcccccccccagaccccccccccccgaggagaaggacgaggagttccccgagcagaaggccggcgaggtgatcaaccagcccatgatgatggccgccagacagctgcacgacgaggccagaaagtggagcagcaagcccggcatccccgccgccgaggtgggcatcggcgtggtggccgaggccgacgccgccgacgccgccggcttccccgtgccccccgacatggaggacgactacgagcccgagctgctgctgatgcccagcaaccagcccgtgaaccagcccatcctggccgccgcccagagcctgcacagagaggccaccaagtggagcagcaagggcaacgacatcatcgccgccgccaagagaatggccctgctgatggccgagatgagcagactggtgagaggcggcagcggcaccaagagagccctgatccagtgcgccaaggacatcgccaaggccagcgacgaggtgaccagactggccaaggaggtggccaagcagtgcaccgacaagagaatcagaaccaacctgctgcaggtgtgcgagagaatccccaccatcagcacccagctgaagatcctgagcaccgtgaaggccaccatgctgggcagaaccaacatcagcgacgaggagagcgagcaggccaccgagatgctggtgcacaacgcccagaacctgatgcagagcgtgaaggagaccgtgagagaggccgaggccgccagcatcaagatcagaaccgacgccggcttcaccctgagatgggtgagaaagaccccctggtaccagtag

SEQ ID NO: 2180 - DNA, 1335 bp, Artificial Sequence
  Description of Artificial Sequence: Synthetic coding sequence
atgtgcctgtgcagcggcagaaagaccatcctggagatctaccccggccagttccagcccagcctgtgccacaagttcatcgccctgagcgacaaggagggcaagctgctgagaaactacacccagaacatcgacaccctggagcaggtggccggcatccagagaatcatccagtgccacggcagcttcgccaccgccagctgcctgatctgcaagtacaaggtggactgcgaggccgtgagaggcgacatcttcaaccaggtggtgcccagatgccccagatgccccgccgacgagcccctggccatcatgaagcccgagatcgtgttcttcggcgagaacctgcccgagcagttccacagagccatgaagtacgacaaggacgaggtggacctgctgatcgtgatcggcagcagcctgaaggtgagacccgtggccctgatccccagcagcatcccccacgaggtgccccagatcctgatcaacagagagcccctgccccacctgcacttcgacgtggagctgctgggcgactgcgacgtgatcatcaacgagctgtgccacagactgggcggcgagtacgccaagctgtgctgcaaccccgtgaagctgagcgagatcaccgagaagccccccagaacccagaaggagctggcctacctgagcgagctgccccccacccccctgcacgtgagcgaggacagcagcagccccgagagaaccagcccccccgacagcagcgtgatcgtgaccctgctggaccaggccgccaagagcaacgacgacctggacgtgagcgagagcaagggctgcatggaggagaagccccaggaggtgcagaccagcagaaacgtggagagcatcgccgagcagatggagaaccccgacctgaagaacgtgggcagcagcaccggcgagaagaacgagagaaccagcgtggccggcaccgtgagaaagtgctggcccaacagagtggccaaggagcagatcagcagaagactggacggcaaccagtacctgttcctgccccccaacagatacatcttccacggcgccgaggtgtacagcgacagcgaggacgacgtgctgagcagcagcagctgcggcagcaacagcgacagcggcacctgccagagccccagcctggaggagcccatggaggacgagagcgagatcgaggagttctacaacggcctggaggacgagcccgacgtgcccgagagagccggcggcgccggcttcggcaccgacggcgacgaccaggaggccatcaacgaggccatcagcgtgaagcaggaggtgaccgacatgaactaccccagcaacaagagctag

SEQ ID NO: 2181 - DNA, 1335 bp, Artificial Sequence; identical to SEQ ID NO: 2180
  Description of Artificial Sequence: Synthetic coding sequence

SEQ ID NO: 2182 - DNA, 1359 bp, Artificial Sequence
  Description of Artificial Sequence: Synthetic coding sequence
atgttcgacatcgagtacttcagaaaggaccccagacccttcttcaagttcgccaaggagatctaccccggccagttccagcccagcctgtgccacaagttcatcgccctgagcgacaaggagggcaagctgctgagaaactacacccagaacatcgacaccctggagcaggtggccggcatccagagaatcatccagtgccacggcagcttcgccaccgccagctgcctgatctgcaagtacaaggtggactgcgaggccgtgagaggcgacatcttcaaccaggtggtgcccagatgccccagatgccccgccgacgagcccctggccatcatgaagcccgagatcgtgttcttcggcgagaacctgcccgagcagttccacagagccatgaagtacgacaaggacgaggtggacctgctgatcgtgatcggcagcagcctgaaggtgagacccgtggccctgatccccagcagcatcccccacgaggtgccccagatcctgatcaacagagagcccctgccccacctgcacttcgacgtggagctgctgggcgactgcgacgtgatcatcaacgagctgtgccacagactgggcggcgagtacgccaagctgtgctgcaaccccgtgaagctgagcgagatcaccgagaagccccccagaacccagaaggagctggcctacctgagcgagctgccccccacccccctgcacgtgagcgaggacagcagcagccccgagagaaccagcccccccgacagcagcgtgatcgtgaccctgctggaccaggccgccaagagcaacgacgacctggacgtgagcgagagcaagggctgcatggaggagaagccccaggaggtgcagaccagcagaaacgtggagagcatcgccgagcagatggagaaccccgacctgaagaacgtgggcagcagcaccggcgagaagaacgagagaaccagcgtggccggcaccgtgagaaagtgctggcccaacagagtggccaaggagcagatcagcagaagactggacggcaaccagtacctgttcctgccccccaacagatacatcttccacggcgccgaggtgtacagcgacagcgaggacgacgtgctgagcagcagcagctgcggcagcaacagcgacagcggcacctgccagagccccagcctggaggagcccatggaggacgagagcgagatcgaggagttctacaacggcctggaggacgagcccgacgtgcccgagagagccggcggcgccggcttcggcaccgacggcgacgaccaggaggccatcaacgaggccatcagcgtgaagcaggaggtgaccgacatgaactaccccagcaacaagagctag

SEQ ID NO: 2183 - DNA, 987 bp, Artificial Sequence
  Description of Artificial Sequence: Synthetic coding sequence
atgagcgtgaactacgccgccggcctgagcccctacgccgacaagggcaagtgcggcctgcccgagatcttcgacccccccgaggagctggagagaaaggtgtgggagctggccagactggtgtggcagagcagcagcgtggtgttccacaccggcgccggcatcagcaccgccagcggcatccccgacttcagaggcccccacggcgtgtggaccatggaggagagaggcctggcccccaagttcgacaccaccttcgagagcgccagacccacccagacccacatggccctggtgcagctggagagagtgggcctgctgagattcctggtgagccagaacgtggacggcctgcacgtgagaagcggcttccccagagacaagctggccgagctgcacggcaacatgttcgtggaggagtgcgccaagtgcaagacccagtacgtgagagacaccgtggtgggcaccatgggcctgaaggccaccggcagactgtgcaccgtggccaaggccagaggcctgagagcctgcagaaacgccgacctgagcatcaccctgggcaccagcctgcagatcagacccagcggcaacctgcccctggccaccaagagaagaggcggcagactggtgatcgtgaacctgcagcccaccaagcacgacagacacgccgacctgagaatccacggctacgtggacgaggtgatgaccagactgatgaagcacctgggcctggagatccccgcctgggacggccccagagtgctggagagagccctgccccccctgcccagaccccccacccccaagctggagcccaaggaggagagccccaccagaatcaacggcagcatccccgccggccccaagcaggagccctgcgcccagcacaacggcagcgagcccgccagccccaagagagagagacccaccagccccgccccccacagaccccccaagagagtgaaggccaaggccgtgcccagctag

SEQ ID NO: 2184 - DNA, 1068 bp, Artificial Sequence
  Description of Artificial Sequence: Synthetic coding sequence
atgagcgtgaactacgccgccggcctgagcccctacgccgacaagggcaagtgcggcctgcccgagatcttcgacccccccgaggagctggagagaaaggtgtgggagctggccagactggtgtggcagagcagcagcgtggtgttccacaccggcgccggcatcagcaccgccagcggcatccccgacttcagaggcccccacggcgtgtggaccatggaggagagaggcctggcccccaagttcgacaccaccttcgagagcgccagacccacccagacccacatggccctggtgcagctggagagagtgggcctgctgagattcctggtgagccagaacgtggacggcctgcacgtgagaagcggcttccccagagacaagctggccgagctgcacggcaacatgttcgtggaggagtgcgccaagtgcaagacccagtacgtgagagacaccgtggtgggcaccatgggcctgaaggccaccggcagactgtgcaccgtggccaaggccagaggcctgagagcctgcagaggcgagctgagagacaccatcctggactgggaggacagcctgcccgacagagacctggccctggccgacgaggccagcagaaacgccgacctgagcatcaccctgggcaccagcctgcagatcagacccagcggcaacctgcccctggccaccaagagaagaggcggcagactggtgatcgtgaacctgcagcccaccaagcacgacagacacgccgacctgagaatccacggctacgtggacgaggtgatgaccagactgatgaagcacctgggcctggagatccccgcctgggacggccccagagtgctggagagagccctgccccccctgcccagaccccccacccccaagctggagcccaaggaggagagccccaccagaatcaacggcagcatccccgccggccccaagcaggagccctgcgcccagcacaacggcagcgagcccgccagccccaagagagagagacccaccagccccgccccccacagaccccccaagagagtgaaggccaaggccgtgcccagctag

SEQ ID NO: 2185 - DNA, 852 bp, Artificial Sequence
  Description of Artificial Sequence: Synthetic coding sequence
atggaggagagaggcctggcccccaagttcgacaccaccttcgagagcgccagacccacccagacccacatggccctggtgcagctggagagagtgggcctgctgagattcctggtgagccagaacgtggacggcctgcacgtgagaagcggcttccccagagacaagctggccgagctgcacggcaacatgttcgtggaggagtgcgccaagtgcaagacccagtacgtgagagacaccgtggtgggcaccatgggcctgaaggccaccggcagactgtgcaccgtggccaaggccagaggcctgagagcctgcagaggcgagctgagagacaccatcctggactgggaggacagcctgcccgacagagacctggccctggccgacgaggccagcagaaacgccgacctgagcatcaccctgggcaccagcctgcagatcagacccagcggcaacctgcccctggccaccaagagaagaggcggcagactggtgatcgtgaacctgcagcccaccaagcacgacagacacgccgacctgagaatccacggctacgtggacgaggtgatgaccagactgatgaagcacctgggcctggagatccccgcctgggacggccccagagtgctggagagagccctgccccccctgcccagaccccccacccccaagctggagcccaaggaggagagccccaccagaatcaacggcagcatccccgccggccccaagcaggagccctgcgcccagcacaacggcagcgagcccgccagccccaagagagagagacccaccagccccgccccccacagaccccccaagagagtgaaggccaaggccgtgcccagctag

SEQ ID NO: 2186 - DNA, 1575 bp, Artificial Sequence
  Description of Artificial Sequence: Synthetic coding sequence
atgaccgaggacaaggtgaccggcaccctggtgttcaccgtgatcaccgccgtgctgggcagcttccagttcggctacgacatcggcgtgatcaacgccccccagcaggtgatcatcagccactacagacacgtgctgggcgtgcccctggacgacagaaaggccatcaacaactacgtgatcaacagcaccgacgagctgcccaccatcagctacagcatgaaccccaagcccaccccctgggccgaggaggagaccgtggccgccgcccagctgatcaccatgctgtggagcctgagcgtgagcagcttcgccgtgggcggcatgaccgccagcttcttcggcggctggctgggcgacaccctgggcagaatcaaggccatgctggtggccaacatcctgagcctggtgggcgccctgctgatgggcttcagcaagctgggccccagccacatcctgatcatcgccggcagaagcatcagcggcctgtactgcggcctgatcagcggcctggtgcccatgtacatcggcgagatcgcccccaccgccctgagaggcgccctgggcaccttccaccagctggccatcgtgaccggcatcctgatcagccagatcatcggcctggagttcatcctgggcaactacgacctgtggcacatcctgctgggcctgagcggcgtgagagccatcctgcagagcctgctgctgttcttctgccccgagagccccagatacctgtacatcaagctggacgaggaggtgaaggccaagcagagcctgaagagactgagaggctacgacgacgtgaccaaggacatcaacgagatgagaaaggagagagaggaggccagcagcgagcagaaggtgagcatcatccagctgttcaccaacagcagctacagacagcccatcctggtggccctgatgctgcacgtggcccagcagttcagcggcatcaacggcatcttctactacagcaccagcatcttccagaccgccggcatcagcaagcccgtgtacgccaccatcggcgtgggcgccgtgaacatggtgttcaccgccgtgagcgtgttcctggtggagaaggccggcagaagaagcctgttcctgatcggcatgagcggcatgttcgtgtgcgccatcttcatgagcgtgggcctggtgctgctgaacaagttcagctggatgagctacgtgagcatgatcgccatcttcctgttcgtgagcttcttcgagatcggccccggccccatcccctggttcatggtggccgagttcttcagccagggccccagacccgccgccctggccatcgccgccttcagcaactggacctgcaacttcatcgtggccctgtgcttccagtacatcgccgacttctgcggcccctacgtgttcttcctgttcgccggcgtgctgctggccttcaccctgttcaccttcttcaaggtgcccgagaccaagggcaagagcttcgaggagatcgccgccgagttccagaagaagagcggcagcgcccacagacccaaggccgccgtggagatgaagttcctgggcgccaccgagaccgtgtag

SEQ ID NO: 2187 - DNA, 1218 bp, Artificial Sequence
  Description of Artificial Sequence: Synthetic coding sequence
atgcacctgaacagaatcaaggccatgctggtggccaacatcctgagcctggtgggcgccctgctgatgggcttcagcaagctgggccccagccacatcctgatcatcgccggcagaagcatcagcggcctgtactgcggcctgatcagcggcctggtgcccatgtacatcggcgagatcgcccccaccgccctgagaggcgccctgggcaccttccaccagctggccatcgtgaccggcatcctgatcagccagatcatcggcctggagttcatcctgggcaactacgacctgtggcacatcctgctgggcctgagcggcgtgagagccatcctgcagagcctgctgctgttcttctgccccgagagccccagatacctgtacatcaagctggacgaggaggtgaaggccaagcagagcctgaagagactgagaggctacgacgacgtgaccaaggacatcaacgagatgagaaaggagagagaggaggccagcagcgagcagaaggtgagcatcatccagctgttcaccaacagcagctacagacagcccatcctggtggccctgatgctgcacgtggcccagcagttcagcggcatcaacggcatcttctactacagcaccagcatcttccagaccgccggcatcagcaagcccgtgtacgccaccatcggcgtgggcgccgtgaacatggtgttcaccgccgtgagcgtgttcctggtggagaaggccggcagaagaagcctgttcctgatcggcatgagcggcatgttcgtgtgcgccatcttcatgagcgtgggcctggtgctgctgaacaagttcagctggatgagctacgtgagcatgatcgccatcttcctgttcgtgagcttcttcgagatcggccccggccccatcccctggttcatggtggccgagttcttcagccagggccccagacccgccgccctggccatcgccgccttcagcaactggacctgcaacttcatcgtggccctgtgcttccagtacatcgccgacttctgcggcccctacgtgttcttcctgttcgccggcgtgctgctggccttcaccctgttcaccttcttcaaggtgcccgagaccaagggcaagagcttcgaggagatcgccgccgagttccagaagaagagcggcagcgcccacagacccaaggccgccgtggagatgaagttcctgggcgccaccgagaccgtgtag

SEQ ID NO: 2188 - DNA, 1290 bp, Artificial Sequence
  Description of Artificial Sequence: Synthetic coding sequence
atggccgcccagggctacggctactacagaaccgtgatcttcagcgccatgttcggcggctacagcctgtactacttcaacagaaagaccttcagcttcgtgatgcccagcctggtggaggagatccccctggacaaggacgacctgggcttcatcaccagcagccagagcgccgcctacgccatcagcaagttcgtgagcggcgtgctgagcgaccagatgagcgccagatggctgttcagcagcggcctgctgctggtgggcctggtgaacatcttcttcgcctggagcagcaccgtgcccgtgttcgccgccctgtggttcctgaacggcctggcccagggcctgggctggcccccctgcggcaaggtgctgagaaagtggttcgagcccagccagttcggcacctggtgggccatcctgagcaccagcatgaacctggccggcggcctgggccccatcctggccaccatcctggcccagagctacagctggagaagcaccctggccctgagcggcgccctgtgcgtggtggtgagcttcctgtgcctgctgctgatccacaacgagcccgccgacgtgggcctgagaaacctggaccccatgcccagcgagggcaagaagggcagcctgaaggaggagagcaccctgcaggagctgctgctgagcccctacctgtgggtgctgagcaccggctacctggtggtgttcggcgtgaagacctgctgcaccgactggggccagttcttcctgatccaggagaagggccagagcgccctggtgggcagcagctacatgagcgccctggaggtgggcggcctggtgggcagcatcgccgccggctacctgagcgacagagccatggccaaggccggcctgagcaactacggcaaccccagacacggcctgctgctgttcatgatggccggcatgaccgtgagcatgtacctgttcagagtgaccgtgaccagcgacagccccaagctgtggatcctggtgctgggcgccgtgttcggcttcagcagctacggccccatcgccctgttcggcgtgatcgccaacgagagcgccccccccaacctgtgcggcaccagccacgccatcgtgggcctgatggccaacgtgggcggcttcctggccggcctgcccttcagcaccatcgccaagcactacagctggagcaccgccttctgggtggccgaggtgatctgcgccgccagcaccgccgccttcttcctgctgagaaacatcagaaccaagatgggcagagtgagcaagaaggccgagtag

SEQ ID NO: 2189 - DNA, 1356 bp, Artificial Sequence
  Description of Artificial Sequence: Synthetic coding sequence
atggccgcccagggctacggctactacagaaccgtgatcttcagcgccatgttcggcggctacagcctgtactacttcaacagaaagaccttcagcttcgtgatgcccagcctggtggaggagatccccctggacaaggacgacctgggcttcatcaccagcagccagagcgccgcctacgccatcagcaagttcgtgagcggcgtgctgagcgaccagatgagcgccagatggctgttcagcagcggcctgctgctggtgggcctggtgaacatcttcttcgcctggagcagcaccgtgcccgtgttcgccgccctgtggttcctgaacggcctggcccagggcctgggctggcccccctgcggcaaggtgctgagaaagtggttcgagcccagccagttcggcacctggtgggccatcctgagcaccagcatgaacctggccggcggcctgggccccatcctggccaccatcctggcccagagctacagctggagaagcaccctggccctgagcggcgccctgtgcgtggtggtgagcttcctgtgcctgctgctgatccacaacgagcccgccgacgtgggcctgagaaacctggaccccatgcccagcgagggcaagaagggcagcctgaaggaggagagcaccctgcaggagctgctgctgagcccctacctgtgggtgctgagcaccggctacctggtggtgttcggcgtgaagacctgctgcaccgactggggccagttcttcctgatccaggagaagggccagagcgccctggtgggcagcagctacatgagcgccctggaggtgggcggcctggtgggcagcatcgccgccggctacctgagcgacagagccatggccaaggccggcctgagcaactacggcaaccccagacacggcctgctgctgttcatgatggccggcatgaccgtgagcatgtacctgttcagagtgaccgtgaccagcgacagccccaaggacgtggccttctggaccctggccctgcaccccctggccgagctgaccggcttcaccgagcacgagctgtggatcctggtgctgggcgccgtgttcggcttcagcagctacggccccatcgccctgttcggcgtgatcgccaacgagagcgccccccccaacctgtgcggcaccagccacgccatcgtgggcctgatggccaacgtgggcggcttcctggccggcctgcccttcagcaccatcgccaagcactacagctggagcaccgccttctgggtggccgaggtgatctgcgccgccagcaccgccgccttcttcctgctgagaaacatcagaaccaagatgggcagagtgagcaagaaggccgagtag

SEQ ID NO: 2190 - DNA, 1716 bp, Artificial Sequence
  Description of Artificial Sequence: Synthetic coding sequence
atgaccagagccggcgaccacaacagacagagaggctgctgcggcagcctggccgactacctgaccagcgccaagttcctgctgtacctgggccacagcctgagcacctggggcgacagaatgtggcacttcgccgtgagcgtgttcctggtggagctgtacggcaacagcctgctgctgaccgccgtgtacggcctggtggtggccggcagcgtgctggtgctgggcgccatcatcggcgactgggtggacaagaacgccagactgaaggtggcccagaccagcctggtggtgcagaacgtgagcgtgatcctgtgcggcatcatcctgatgatggtgttcctgcacaagcacgagctgctgaccatgtaccacggctgggtgctgaccagctgctacatcctgatcatcaccatcgccaacatcgccaacctggccagcaccgccaccgccatcaccatccagagagactggatcgtggtggtggccggcgaggacagaagcaagctggccaacatgaacgccaccatcagaagaatcgaccagctgaccaacatcctggcccccatggccgtgggccagatcatgaccttcggcagccccgtgatcggctgcggcttcatcagcggctggaacctggtgagcatgtgcgtggagtacgtgctgctgtggaaggtgtaccagaagacccccgccctggccgtgaaggccggcctgaaggaggaggagaccgagctgaagcagctgaacctgcacaaggacaccgagcccaagcccctggagggcacccacctgatgggcgtgaaggacagcaacatccacgagctggagcacgagcaggagcccacctgcgccagccagatggccgagcccttcagaaccttcagagacggctgggtgagctactacaaccagcccgtgttcctggccggcatgggcctggccttcctgtacatgaccgtgctgggcttcgactgcatcaccaccggctacgcctacacccagggcctgagcggcagcatcctgagcatcctgatgggcgccagcgccatcaccggcatcatgggcaccgtggccttcacctggctgagaagaaagtgcggcctggtgagaaccggcctgatcagcggcctggcccagctgagctgcctgatcctgtgcgtgatcagcgtgttcatgcccggcagccccctggacctgagcgtgagccccttcgaggacatcagaagcagattcatccagggcgagagcatcacccccaccaagatccccgagatcaccaccgagatctacatgagcaacggcagcaacagcgccaacatcgtgcccgagaccagccccgagagcgtgcccatcatcagcgtgagcctgctgttcgccggcgtgatcgccgccagaatcggcctgtggagcttcgacctgaccgtgacccagctgctgcaggagaacgtgatcgagagcgagagaggcatcatcaacggcgtgcagaacagcatgaactacctgctggacctgctgcacttcatcatggtgatcctggcccccaaccccgaggccttcggcctgctggtgctgatcagcgtgagcttcgtggccatgggccacatcatgtacttcagattcgcccagaacaccctgggcaacaagctgttcgcctgcggccccgacgccaaggaggtgagaaaggagaaccaggccaacaccagcgtggtgtag

SEQ ID NO: 2191 - DNA, 603 bp, Artificial Sequence
  Description of Artificial Sequence: Synthetic coding sequence
atgaccagagccggcgaccacaacagacagagaggctgctgcggcagcctggccgactacctgaccagcgccaagttcctgctgtacctgggccacagcctgagcacctggggcgacagaatgtggcacttcgccgtgagcgtgttcctggtggagctgtacggcaacagcctgctgctgaccgccgtgtacggcctggtggtggccggcagcgtgctggtgctgggcgccatcatcggcgactgggtggacaagaacgccagactgaaggtggcccagaccagcctggtggtgcagaacgtgagcgtgatcctgtgcggcatcatcctgatgatggtgttcctgcacaagcacgagctgctgaccatgtaccacggctgggtgctgaccagctgctacatcctgatcatcaccatcgccaacatcgccaacctggccagcaccgccaccgccatcaccatccagagagactggatcgtggtggtggccggcgaggacagaagcaagctggccaacatgaacgccaccatcagaagaatcgaccagctgaccaacatcctggcccccatggccgtgggccagatcatgaccttcggcagctag

SEQ ID NO: 2192 - DNA, 78 bp, Artificial Sequence
  Description of Artificial Sequence: Synthetic coding sequence
atgaccagagccggcgaccacaacagacagagaggctgctgcggcagcctggccgactacctgaccagcgccaagtag

SEQ ID NO: 2193 - DNA, 78 bp, Artificial Sequence; identical to SEQ ID NO: 2192
  Description of Artificial Sequence: Synthetic coding sequence

SEQ ID NO: 2194 - DNA, 168 bp, Artificial Sequence
  Description of Artificial Sequence: Synthetic coding sequence
atgaccagagccggcgaccacaacagacagagaggctgctgcggcagcctggccgactacctgaccagcgccaagttcctgctgtacctgggccacagcctgagcacctggggcgacagaatgtggcacttcgccgtgagcgtgttcctggtggagctgtacggctag

SEQ ID NO: 2195 - DNA, 300 bp, Artificial Sequence
  Description of Artificial Sequence: Synthetic coding sequence
atgagagccagcatccacaagaagctgagaaagagcagcggcatcgtgaccatcctgtacagcgccttcgtgctggtgagcaccagcgacatggccgaggagaccgaggacgcctggcccagatgctacctgcagttcctggccctgctgctgaccagcaccagcgccagagccgccgccgccatcgccgccgccgaggagcccgccggcagccccagcgtgatgaccagagccggcgaccacaacagacagagaggctgctgcggcagcctggccgactacctgaccagcgccaagtag

SEQ ID NO: 2196 - DNA, 504 bp, Artificial Sequence
  Description of Artificial Sequence: Synthetic coding sequence
atgggcgtgaaggacagcaacatccacgagctggagcacgagcaggagcccacctgcgccagccagatggccgagcccttcagaaccttcagagacggctgggtgagctactacaaccagcccgtgttcctggccggcatgggcctggccttcctgtacatgaccgtgctgggcttcgactgcatcaccaccggctacgcctacacccagggcctgagcggcagcatcctgagcatcctgatgggcgccagcgccatcaccggcatcatgggcaccgtggccttcacctggctgagaagaaagtgcggcctggtgagaaccggcctgatcagcggcctggcccagctgagctgcctgatcctgtgcgtgatcagcgtgttcatgcccggcagccccctggacctgagcgtgagccccttcgaggacatcagaagcagattcatccagggcgagagcatcacccccaccaagatccccgagatcaccaccgagatccacgtgtag

SEQ ID NO: 2197 - DNA, 2496 bp, Artificial Sequence
  Description of Artificial Sequence: Synthetic coding sequence
atggagagaccctggggcgccgccgacggcctgagcagatggccccacggcctgggcctgctgctgctgctgcagctgctgccccccagcaccctgagccaggacagactggacgccccccccccccccgccgcccccctgcccagatggagcggccccatcggcgtgagctggggcctgagagccgccgccgccggcggcgccttccccagaggcggcagatggagaagaagcgcccccggcgaggacgaggagtgcggcagagtgagagacttcgtggccaagctggccaacaacacccaccagcacgtgttcgacgacctgagaggcagcgtgagcctgagctgggtgggcgacagcaccggcgtgatcctggtgctgaccaccttccacgtgcccctggtgatcatgaccttcggccagagcaagctgtacagaagcgaggactacggcaagaacttcaaggacatcaccgacctgatcaacaacaccttcatcagaaccgagttcggcatggccatcggccccgagaacagcggcaaggtggtgctgaccgccgaggtgagcggcggcagcagaggcggcagaatcttcagaagcagcgacttcgccaagaacttcgtgcagaccgacctgcccttccaccccctgacccagatgatgtacagcccccagaacagcgactacctgctggccctgagcaccgagaacggcctgtgggtgagcaagaacttcggcggcaagtgggaggagatccacaaggccgtgtgcctggccaagtggggcagcgacaacaccatcttcttcaccacctacgccaacggcagctgcaaggccgacctgggcgccctggagctgtggagaaccagcgacctgggcaagagcttcaagaccatcggcgtgaagatctacagcttcggcctgggcggcagattcctgttcgccagcgtgatggccgacaaggacaccaccagaagaatccacgtgagcaccgaccagggcgacacctggagcatggcccagctgcccagcgtgggccaggagcagttctacagcatcctggccgccaacgacgacatggtgttcatgcacgtggacgagcccggcgacaccggcttcggcaccatcttcaccagcgacgacagaggcatcgtgtacagcaagagcctggacagacacctgtacaccaccaccggcggcgagaccgacttcaccaacgtgaccagcctgagaggcgtgtacatcaccagcgtgctgagcgaggacaacagcatccagaccatgatcaccttcgaccagggcggcagatggacccacctgagaaagcccgagaacagcgagtgcgacgccaccgccaagaacaagaacgagtgcagcctgcacatccacgccagctacagcatcagccagaagctgaacgtgcccatggcccccctgagcgagcccaacgccgtgggcatcgtgatcgcccacggcagcgtgggcgacgccatcagcgtgatggtgcccgacgtgtacatcagcgacgacggcggctacagctggaccaagatgctggagggcccccactactacaccatcctggacagcggcggcatcatcgtggccatcgagcacagcagcagacccatcaacgtgatcaagttcagcaccgacgagggccagtgctggcagacctacaccttcaccagagaccccatctacttcaccggcctggccagcgagcccggcgccagaagcatgaacatcagcatctggggcttcaccgagagcttcctgaccagccagtgggtgagctacaccatcgacttcaaggacatcctggagagaaactgcgaggagaaggactacaccatctggctggcccacagcaccgaccccgaggactacgaggacggctgcatcctgggctacaaggagcagttcctgagactgagaaagagcagcgtgtgccagaacggcagagactacgtggtgaccaagcagcccagcatctgcctgtgcagcctggaggacttcctgtgcgacttcggctactacagacccgagaacgacagcaagtgcgtggagcagcccgagctgaagggccacgacctggagttctgcctgtacggcagagaggagcacctgaccaccaacggctacagaaagatccccggcgacaagtgccagggcggcgtgaaccccgtgagagaggtgaaggacctgaagaagaagtgcaccagcaacttcctgagccccgagaagcagaacagcaagagcaacagcgtgcccatcatcctggccatcgtgggcctgatgctggtgaccgtggtggccggcgtgctgatcgtgaagaagtacgtgtgcggcggcagattcctggtgcacagatacagcgtgctgcagcagcacgccgaggccaacggcgtggacggcgtggacgccctggacaccgccagccacaccaacaagagcggctaccacgacgacagcgacgaggacctgctggagtag

SEQ ID NO: 2198 - DNA, 2085 bp, Artificial Sequence
  Description of Artificial Sequence: Synthetic coding sequence
atgaccttcggccagagcaagctgtacagaagcgaggactacggcaagaacttcaaggacatcaccgacctgatcaacaacaccttcatcagaaccgagttcggcatggccatcggccccgagaacagcggcaaggtggtgctgaccgccgaggtgagcggcggcagcagaggcggcagaatcttcagaagcagcgacttcgccaagaacttcgtgcagaccgacctgcccttccaccccctgacccagatgatgtacagcccccagaacagcgactacctgctggccctgagcaccgagaacggcctgtgggtgagcaagaacttcggcggcaagtgggaggagatccacaaggccgtgtgcctggccaagtggggcagcgacaacaccatcttcttcaccacctacgccaacggcagctgcaccgacctgggcgccctggagctgtggagaaccagcgacctgggcaagagcttcaagaccatcggcgtgaagatctacagcttcggcctgggcggcagattcctgttcgccagcgtgatggccgacaaggacaccaccagaagaatccacgtgagcaccgaccagggcgacacctggagcatggcccagctgcccagcgtgggccaggagcagttctacagcatcctggccgccaacgacgacatggtgttcatgcacgtggacgagcccggcgacaccggcttcggcaccatcttcaccagcgacgacagaggcatcgtgtacagcaagagcctggacagacacctgtacaccaccaccggcggcgagaccgacttcaccaacgtgaccagcctgagaggcgtgtacatcaccagcgtgctgagcgaggacaacagcatccagaccatgatcaccttcgaccagggcggcagatggacccacctgagaaagcccgagaacagcgagtgcgacgccaccgccaagaacaagaacgagtgcagcctgcacatccacgccagctacagcatcagccagaagctgaacgtgcccatggcccccctgagcgagcccaacgccgtgggcatcgtgatcgcccacggcagcgtgggcgacgccatcagcgtgatggtgcccgacgtgtacatcagcgacgacggcggctacagctggaccaagatgctggagggcccccactactacaccatcctggacagcggcggcatcatcgtggccatcgagcacagcagcagacccatcaacgtgatcaagttcagcaccgacgagggccagtgctggcagacctacaccttcaccagagaccccatctacttcaccggcctggccagcgagcccggcgccagaagcatgaacatcagcatctggggcttcaccgagagcttcctgaccagccagtgggtgagctacaccatcgacttcaaggacatcctggagagaaactgcgaggagaaggactacaccatctggctggcccacagcaccgaccccgaggactacgaggacggctgcatcctgggctacaaggagcagttcctgagactgagaaagagcagcgtgtgccagaacggcagagactacgtggtgaccaagcagcccagcatctgcctgtgcagcctggaggacttcctgtgcgacttcggctactacagacccgagaacgacagcaagtgcgtggagcagcccgagctgaagggccacgacctggagttctgcctgtacggcagagaggagcacctgaccaccaacggctacagaaagatccccggcgacaagtgccagggcggcgtgaaccccgtgagagaggtgaaggacctgaagaagaagtgcaccagcaacttcctgagccccgagaagcagaacagcaagagcaacagcgtgcccatcatcctggccatcgtgggcctgatgctggtgaccgtggtggccggcgtgctgatcgtgaagaagtacgtgtgcggcggcagattcctggtgcacagatacagcgtgctgcagcagcacgccgaggccaacggcgtggacggcgtggacgccctggacaccgccagccacaccaacaagagcggctaccacgacgacagcgacgaggacctgctggagtag

SEQ ID NO: 2199 - DNA, 1446 bp, Artificial Sequence
  Description of Artificial Sequence: Synthetic coding sequence
atgaaggtgctgagcgagggccagctgaagctgtgcgtggtgcagcccgtgcacctgaccagctggctgctgatcttcttcatcctgaagagcatcagctgcctgaagcccgccagactgcccatctaccagagaaagcccttcatcgccgcctggaacgcccccaccgaccagtgcctgatcaagtacaacctgagactgaacctgaagatgttccccgtgatcggcagccccctggccaaggccagaggccagaacgtgaccatcttctacgtgaacagactgggctactacccctggtacaccagccagggcgtgcccatcaacggcggcctgccccagaacatcagcctgcaggtgcacctggagaaggccgaccaggacatcaactactacatccccgccgaggacttcagcggcctggccgtgatcgactgggagtactggagaccccagtgggccagaaactggaacagcaaggacgtgtacagacagaagagcagaaagctgatcagcgacatgggcaagaacgtgagcgccaccgacatcgagtacctggccaaggtgaccttcgaggagagcgccaaggccttcatgaaggagaccatcaagctgggcatcaagagcagacccaagggcctgtggggctactacctgtaccccgactgccacaactacaacgtgtacgcccccaactacagcggcagctgccccgaggacgaggtgctgagaaacaacgagctgagctggctgtggaacagcagcgccgccctgtaccccagcatcggcgtgtggaagagcctgggcgacagcgagaacatcctgagattcagcaagttcagagtgcacgagagcatgagaatcagcaccatgaccagccacgactacgccctgcccgtgttcgtgtacaccagactgggctacagagacgagcccctgttcttcctgagcaagcaggacctggtgagcaccatcggcgagagcgccgccctgggcgccgccggcatcgtgatctggggcgacatgaacctgaccgccagcaaggccaactgcaccaaggtgaagcagttcgtgagcagcgacctgggcagctacatcgccaacgtgaccagagccgccgaggtgtgcagcctgcacctgtgcagaaacaacggcagatgcatcagaaagatgtggaacgcccccagctacctgcacctgaaccccgccagctaccacatcgaggccagcgaggacggcgagttcaccgtgaagggcaaggccagcgacaccgacctggccgtgatggccgacaccttcagctgccactgctaccagggctacgagggcgccgactgcagagagatcaagaccgccgacggctgcagcggcgtgagccccagccccggcagcctgatgaccctgtgcctgctgctgctggccagctacagaagcatccagctgtag

SEQ ID NO: 2200 - DNA, 1536 bp, Artificial Sequence
  Description of Artificial Sequence: Synthetic coding sequence
atgggcgtgctgaagttcaagcacatcttcttcagaagcttcgtgaagagcagcggcgtgagccagatcgtgttcaccttcctgctgatcccctgctgcctgaccctgaacttcagagccccccccgtgatccccaacgtgcccttcctgtgggcctggaacgcccccagcgagttctgcctgggcaagttcgacgagcccctggacatgagcctgttcagcttcatcggcagccccagaatcaacgccaccggccagggcgtgaccatcttctacgtggacagactgggctactacccctacatcgacagcatcaccggcgtgaccgtgaacggcggcatcccccagaagatcagcctgcaggaccacctggacaaggccaagaaggacatcaccttctacatgcccgtggacaacctgggcatggccgtgatcgactgggaggagtggagacccacctgggccagaaactggaagcccaaggacgtgtacaagaacagaagcatcgagctggtgcagcagcagaacgtgcagctgagcctgaccgaggccaccgagaaggccaagcaggagttcgagaaggccggcaaggacttcctggtggagaccatcaagctgggcaagctgctgagacccaaccacctgtggggctactacctgttccccgactgctacaaccaccactacaagaagcccggctacaacggcagctgcttcaacgtggagatcaagagaaacgacgacctgagctggctgtggaacgagagcaccgccctgtaccccagcatctacctgaacacccagcagagccccgtggccgccaccctgtacgtgagaaacagagtgagagaggccatcagagtgagcaagatccccgacgccaagagccccctgcccgtgttcgcctacaccagaatcgtgttcaccgaccaggtgctgaagttcctgagccaggacgagctggtgtacaccttcggcgagaccgtggccctgggcgccagcggcatcgtgatctggggcaccctgagcatcatgagaagcatgaagagctgcctgctgctggacaactacatggagaccatcctgaacccctacatcatcaacgtgaccctggccgccaagatgtgcagccaggtgctgtgccaggagcagggcgtgtgcatcagaaagaactggaacagcagcgactacctgcacctgaaccccgacaacttcgccatccagctggagaagggcggcaagttcaccgtgagaggcaagcccaccctggaggacctggagcagttcagcgagaagttctactgcagctgctacagcaccctgagctgcaaggagaaggccgacgtgaaggacaccgacgccgtggacgtgtgcatcgccgacggcgtgtgcatcgacgccttcctgaagccccccatggagaccgaggagccccagatcttctacaacgccagccccagcaccctgagcgccaccatgttcatctggagactggaggtgtgggaccagggcatcagcagaatcggcttcttctag

SEQ ID NO: 2201 - DNA, 1530 bp, Artificial Sequence
  Description of Artificial Sequence: Synthetic coding sequence
atgggcgtgctgaagttcaagcacatcttcttcagaagcttcgtgaagagcagcggcgtgagccagatcgtgttcaccttcctgctgatcccctgctgcctgaccctgaacttcagagccccccccgtgatccccaacgtgcccttcctgtgggcctggaacgcccccagcgagttctgcctgggcaagttcgacgagcccctggacatgagcctgttcagcttcatcggcagccccagaatcaacgccaccggccagggcgtgaccatcttctacgtggacagactgggctactacccctacatcgacagcatcaccggcgtgaccgtgaacggcggcatcccccagaagatcagcctgcaggaccacctggacaaggccaagaaggacatcaccttctacatgcccgtggacaacctgggcatggccgtgatcgactgggaggagtggagacccacctgggccagaaactggaagcccaaggacgtgtacaagaacagaagcatcgagctggtgcagcagcagaacgtgcagctgagcctgaccgaggccaccgagaaggccaagcaggagttcgagaaggccggcaaggacttcctggtggagaccatcaagctgggcaagctgctgagacccaaccacctgtggggctactacctgttccccgactgctacaaccaccactacaagaagcccggctacaacggcagctgcttcaacgtggagatcaagagaaacgacgacctgagctggctgtggaacgagagcaccgccctgtaccccagcatctacctgaacacccagcagagccccgtggccgccaccctgtacgtgagaaacagagtgagagaggccatcagagtgagcaagatccccgacgccaagagccccctgcccgtgttcgcctacaccagaatcgtgttcaccgaccaggtgctgaagttcctgagccaggacgagctggtgtacaccttcggcgagaccgtggccctgggcgccagcggcatcgtgatctggggcaccctgagcatcatgagaagcatgaagagctgcctgctgctggacaactacatggagaccatcctgaacccctacatcatcaacgtgaccctggccgccaagatgtgcagccaggtgctgtgccaggagcagggcgtgtgcatcagaaagaactggaacagcagcgactacctgcacctgaaccccgacaacttcgccatccagctggagaagggcggcaagttcaccgtgagaggcaagcccaccctggaggacctggagcagttcagcgagaagttctactgcagctgctacagcaccctgagctgcaaggagaaggccgacgtgaaggacaccgacgccgtggacgtgtgcatcgccgacggcgtgtgcatcgacgccttcctgaagccccccatggagaccgaggagccccagatcttctacaacgccagccccagcaccctgagcgccaccatgttcatcgtgagcatcctgttcctgatcatcagcagcgtggccagcctgtag

SEQ ID NO: 2202 - DNA, 243 bp, Artificial Sequence
  Description of Artificial Sequence: Synthetic coding sequence
atgggcgtgctgaagttcaagcacatcttcttcagaagcttcgtgaagagcagcggcgtgagccagatcgtgttcaccttcctgctgatcccctgctgcctgaccctgaacttcagagccccccccgtgatccccaacgtgcccttcctgtgggcctggaacgcccccagcgagttctgcctgggcaagttcgacgagcccctggacatgagcctgttcagcttcatcggcagccccagatag

SEQ ID NO: 2203 - DNA, 1530 bp, Artificial Sequence; identical to SEQ ID NO: 2201
  Description of Artificial Sequence: Synthetic coding sequence

SEQ ID NO: 2204 - DNA, 1530 bp, Artificial Sequence; identical to SEQ ID NO: 2201
  Description of Artificial Sequence: Synthetic coding sequence

SEQ ID NO: 2205 - DNA, 1764 bp, Artificial Sequence
  Description of Artificial Sequence: Synthetic coding sequence
atgcccagatacggcgccagcctgagacagagctgccccagaagcggcagagagcagggccaggacggcaccgccggcgcccccggcctgctgtggatgggcctggtgctggccctggccctggccctggccctggccctggccctgagcgacagcagagtgctgtgggcccccgccgaggcccaccccctgagcccccagggccaccccgccagactgcacagaatcgtgcccagactgagagacgtgttcggctggggcaacctgacctgccccatctgcaagggcctgttcaccgccatcaacctgggcctgaagaaggagcccaacgtggccagagtgggcagcgtggccatcaagctgtgcaacctgctgaagatcgccccccccgccgtgtgccagagcatcgtgcacctgttcgaggacgacatggtggaggtgtggagaagaagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagcagaatcctgttcctgaccgacctgcactgggaccacgactacctggagggcaccgaccccgactgcgccgaccccctgtgctgcagaagaggcagcggcctgccccccgccagcagacccggcgccggctactggggcgagtacagcaagtgcgacctgcccctgagaaccctggagagcctgctgagcggcctgggccccgccggccccttcgacatggtgtactggaccggcgacatccccgcccacgacgtgtggcaccagaccagacaggaccagctgagagccctgaccaccgtgaccgccctggtgagaaagttcctgggccccgtgcccgtgtaccccgccgtgggcaaccacgagagcacccccgtgaacagcttccccccccccttcatcgagggcaaccacagcagcagatggctgtacgaggccatggccaaggcctgggagccctggctgcccgccgaggccctgagaaccctgagatacctgagcagcgtggagacccaggagggcaagagaaaggtgcacatcatcggccacatcccccccggccactgcctgaagagctggagctggaactactacagaatcgtggccagatacgagaacaccctggccgcccagttcttcggccacacccacgtggacgagttcgaggtgttctacgacgaggagaccctgagcagacccctggccgtggccttcctggcccccagcgccaccacctacatcggcctgaaccccggctacagagtgtaccagatcgacggcaactacagcggcagcagccacgtggtgctggaccacgagacctacatcctgaacctgacccaggccaacatccccggcgccatcccccactggcagctgctgtacagagccagagagacctacggcctgcccaacaccctgcccaccgcctggcacaacctggtgtacagaatgagaggcgacatgcagctgttccagaccttctggttcctgtaccacaagggccacccccccagcgagccctgcggcaccccctgcagactggccaccctgtgcgcccagctgagcgccagagccgacagccccgccctgtgcagacacctgatgcccgacggcagcctgcccgaggcccagagcctgtggcccagacccctgttctgctag

SEQ ID NO: 2206 - DNA, 1896 bp, Artificial Sequence
  Description of Artificial Sequence: Synthetic coding sequence
atgcccagatacggcgccagcctgagacagagctgccccagaagcggcagagagcagggccaggacggcaccgccggcgcccccggcctgctgtggatgggcctggtgctggccctggccctggccctggccctggccctggccctgagcgacagcagagtgctgtgggcccccgccgaggcccaccccctgagcccccagggccaccccgccagactgcacagaatcgtgcccagactgagagacgtgttcggctggggcaacctgacctgccccatctgcaagggcctgttcaccgccatcaacctgggcctgaagaaggagcccaacgtggccagagtgggcagcgtggccatcaagctgtgcaacctgctgaagatcgccccccccgccgtgtgccagagcatcgtgcacctgttcgaggacgacatggtggaggtgtggagaagaagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagcagaatcctgttcctgaccgacctgcactgggaccacgactacctggagggcaccgaccccgactgcgccgaccccctgtgctgcagaagaggcagcggcctgccccccgccagcagacccggcgccggctactggggcgagtacagcaagtgcgacctgcccctgagaaccctggagagcctgctgagcggcctgggccccgccggccccttcgacatggtgtactggaccggcgacatccccgcccacgacgtgtggcaccagaccagacaggaccagctgagagccctgaccaccgtgaccgccctggtgagaaagttcctgggccccgtgcccgtgtaccccgccgtgggcaaccacgagagcacccccgtgaacagcttccccccccccttcatcgagggcaaccacagcagcagatggctgtacgaggccatggccaaggcctgggagccctggctgcccgccgaggccctgagaaccctgagaatcggcggcttctacgccctgagcccctaccccggcctgagactgatcagcctgaacatgaacttctgcagcagagagaacttctggctgctgatcaacagcaccgaccccgccggccagctgcagtggctggtgggcgagctgcaggccgccgaggacagaggcgacaaggtgcacatcatcggccacatcccccccggccactgcctgaagagctggagctggaactactacagaatcgtggccagatacgagaacaccctggccgcccagttcttcggccacacccacgtggacgagttcgaggtgttctacgacgaggagaccctgagcagacccctggccgtggccttcctggcccccagcgccaccacctacatcggcctgaaccccggctacagagtgtaccagatcgacggcaactacagcggcagcagccacgtggtgctggaccacgagacctacatcctgaacctgacccaggccaacatccccggcgccatcccccactggcagctgctgtacagagccagagagacctacggcctgcccaacaccctgcccaccgcctggcacaacctggtgtacagaatgagaggcgacatgcagctgttccagaccttctggttcctgtaccacaagggccacccccccagcgagccctgcggcaccccctgcagactggccaccctgtgcgcccagctgagcgccagagccgacagccccgccctgtgcagacacctgatgcccgacggcagcctgcccgaggcccagagcctgtggcccagacccctgttctgctag

SEQ ID NO: 2207 - DNA, 1728 bp, Artificial Sequence
  Description of Artificial Sequence: Synthetic coding sequence
atgcccagatacggcgccagcctgagacagagctgccccagaagcggcagagagcagggccaggacggcaccgccggcgcccccggcctgctgtggatgggcctggtgctggccctggccctggccctggccctggccctggccctgagcgacagcagagtgctgtgggcccccgccgaggcccaccccctgagcccccagggccaccccgccagactgcacagaatcgtgcccagactgagagacgtgttcggctggggcaacctgacctgccccatctgcaagggcctgttcaccgccatcaacctgggcctgaagaaggagcccaacgtggccagagtgggcagcgtggccatcaagctgtgcaacctgctgaagatcgccccccccgccgtgtgccagagcatcgtgcacctgttcgaggacgacatggtggaggtgtggagaagaagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagcagaatcctgttcctgaccgacctgcactgggaccacgactacctggagggcaccgaccccgactgcgccgaccccctgtgctgcagaagaggcagcggcctgccccccgccagcagacccggcgccggctactggggcgagtacagcaagtgcgacctgcccctgagaaccctggagagcctgctgagcggcctgggccccgccggccccttcgacatggtgtactggaccggcgacatccccgcccacgacgtgtggcaccagaccagacaggaccagctgagagccctgaccaccgtgaccgccctggtgagaaagttcctgggccccgtgcccgtgtaccccgccgtgggcaaccacgagagcacccccgtgaacagcttccccccccccttcatcgagggcaaccacagcagcagatggctgtacgaggccatggccaaggcctgggagccctggctgcccgccgaggccctgagaaccctgagaaaggtgcacatcatcggccacatcccccccggccactgcctgaagagctggagctggaactactacagaatcgtggccagatacgagaacaccctggccgcccagttcttcggccacacccacgtggacgagttcgaggtgttctacgacgaggagaccctgagcagacccctggccgtggccttcctggcccccagcgccaccacctacatcggcctgaaccccggctacagagtgtaccagatcgacggcaactacagcggcagcagccacgtggtgctggaccacgagacctacatcctgaacctgacccaggccaacatccccggcgccatcccccactggcagctgctgtacagagccagagagacctacggcctgcccaacaccctgcccaccgcctggcacaacctggtgtacagaatgagaggcgacatgcagctgttccagaccttctggttcctgtaccacaagggccacccccccagcgagccctgcggcaccccctgcagactggccaccctgtgcgcccagctgagcgccagagccgacagccccgccctgtgcagacacctgatgcccgacggcagcctgcccgaggcccagagcctgtggcccagacccctgttctgctag

SEQ ID NO: 2208 - DNA, 1893 bp, Artificial Sequence
  Description of Artificial Sequence: Synthetic coding sequence
atgcccagatacggcgccagcctgagacagagctgccccagaagcggcagagagcagggccaggacggcaccgccggcgcccccggcctgctgtggatgggcctggtgctggccctggccctggccctggccctggccctggccctgagcgacagcagagtgctgtgggcccccgccgaggcccaccccctgagcccccagggccaccccgccagactgcacagaatcgtgcccagactgagagacgtgttcggctggggcaacctgacctgccccatctgcaagggcctgttcaccgccatcaacctgggcctgaaggagcccaacgtggccagagtgggcagcgtggccatcaagctgtgcaacctgctgaagatcgccccccccgccgtgtgccagagcatcgtgcacctgttcgaggacgacatggtggaggtgtggagaagaagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagcagaatcctgttcctgaccgacctgcactgggaccacgactacctggagggcaccgaccccgactgcgccgaccccctgtgctgcagaagaggcagcggcctgccccccgccagcagacccggcgccggctactggggcgagtacagcaagtgcgacctgcccctgagaaccctggagagcctgctgagcggcctgggccccgccggccccttcgacatggtgtactggaccggcgacatccccgcccacgacgtgtggcaccagaccagacaggaccagctgagagccctgaccaccgtgaccgccctggtgagaaagttcctgggccccgtgcccgtgtaccccgccgtgggcaaccacgagagcacccccgtgaacagcttccccccccccttcatcgagggcaaccacagcagcagatggctgtacgaggccatggccaaggcctgggagccctggctgcccgccgaggccctgagaaccctgagaatcggcggcttctacgccctgagcccctaccccggcctgagactgatcagcctgaacatgaacttctgcagcagagagaacttctggctgctgatcaacagcaccgaccccgccggccagctgcagtggctggtgggcgagctgcaggccgccgaggacagaggcgacaaggtgcacatcatcggccacatcccccccggccactgcctgaagagctggagctggaactactacagaatcgtggccagatacgagaacaccctggccgcccagttcttcggccacacccacgtggacgagttcgaggtgttctacgacgaggagaccctgagcagacccctggccgtggccttcctggcccccagcgccaccacctacatcggcctgaaccccggctacagagtgtaccagatcgacggcaactacagcggcagcagccacgtggtgctggaccacgagacctacatcctgaacctgacccaggccaacatccccggcgccatcccccactggcagctgctgtacagagccagagagacctacggcctgcccaacaccctgcccaccgcctggcacaacctggtgtacagaatgagaggcgacatgcagctgttccagaccttctggttcctgtaccacaagggccacccccccagcgagccctgcggcaccccctgcagactggccaccctgtgcgcccagctgagcgccagagccgacagccccgccctgtgcagacacctgatgcccgacggcagcctgcccgaggcccagagcctgtggcccagacccctgttctgctag

SEQ ID NO: 2209 - DNA, 1101 bp, Artificial Sequence
  Description of Artificial Sequence: Synthetic coding sequence
atgcccagatacggcgccagcctgagacagagctgccccagaagcggcagagagcagggccaggacggcaccgccggcgcccccggcctgctgtggatgggcctggtgctggccctggccctggccctggccctggccctggccctgagcgacagcagagtgctgtgggcccccgccgaggcccaccccctgagcccccagggccaccccgccagactgcacagaatcgtgcccagactgagagacgtgttcggctggggcaacctgacctgccccatctgcaagggcctgttcaccgccatcaacctgggcctgaagaaggagcccaacgtggccagagtgggcagcgtggccatcaagctgtgcaacctgctgaagatcgccccccccgccgtgtgccagagcatcgtgcacctgttcgaggacgacatggtggaggtgtggagaagaagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagcagaatcctgttcctgaccgacctgcactgggaccacgactacctggagggcaccgaccccgactgcgccgaccccctgtgctgcagaagaggcagcggcctgccccccgccagcagacccggcgccggctactggggcgagtacagcaagtgcgacctgcccctgagaaccctggagagcctgctgagcggcctgggccccgccggccccttcgacatggtgtactggaccggcgacatccccgcccacgacgtgtggcaccagaccagacaggaccagctgagagccctgaccaccgtgaccgccctggtgagaaagttcctgggccccgtgcccgtgtaccccgccgtgggcaaccacgagagcacccccgtgaacagcttccccccccccttcatcgagggcaaccacagcagcagatggctgtacgaggccatggccaaggcctgggagccctggctgcccgccgaggccctgagaaccctgagatgcatctag

SEQ ID NO: 2210 - DNA, 1209 bp, Artificial Sequence
  Description of Artificial Sequence: Synthetic coding sequence
atgcccagatacggcgccagcctgagacagagctgccccagaagcggcagagagcagggccaggacggcaccgccggcgcccccggcctgctgtggatgggcctggtgctggccctggccctggccctggccctggccctggccctgagcgacagcagagtgctgtgggcccccgccgaggcccaccccctgagcccccagggccaccccgccagactgcacagaatcgtgcccagactgagagacgtgttcggctggggcaacctgacctgccccatctgcaagggcctgttcaccgccatcaacctgggcctgaagaaggagcccaacgtggccagagtgggcagcgtggccatcaagctgtgcaacctgctgaagatcgccccccccgccgtgtgccagagcatcgtgcacctgttcgaggacgacatggtggaggtgtggagaagaagcgtgctgagccccagcgaggcctgcggcctgctgctgggcagcacctgcggccactgggacatcttcagcagctggaacatcagcctgcccaccgtgcccaagcccccccccaagccccccagcccccccgcccccggcgcccccgtgagcagaatcctgttcctgaccgacctgcactgggaccacgactacctggagggcaccgaccccgactgcgccgaccccctgtgctgcagaagaggcagcggcctgccccccgccagcagacccggcgccggctactggggcgagtacagcaagtgcgacctgcccctgagaaccctggagagcctgctgagcggcctgggccccgccggccccttcgacatggtgtactggaccggcgacatccccgcccacgacgtgtggcaccagaccagacaggaccagctgagagccctgaccaccgtgaccgccctggtgagaaagttcctgggccccgtgcccgtgtaccccgccgtgggcaaccacgagagcacccccgtgaacagcttccccccccccttcatcgagggcaaccacagcagcagatggctgtacgaggccatggccaaggcctgggagccctggctgcccgccgaggccctgagaaccctgagatacctgagcagcgtggagacccaggagggcaagagaaagaactggggcgtgctgtgcagcttccccatccccagaagccccccccacctgagccagtacgagttcctgttcccctag

SEQ ID NO: 2211 - DNA, 954 bp, Artificial Sequence
  Description of Artificial Sequence: Synthetic coding sequence
atgtacaacatgatggagaccgagctgaagccccccggcccccagcagaccagcggcggcggcggcggcaacagcaccgccgccgccgccggcggcaaccagaagaacagccccgacagagtgaagagacccatgaacgccttcatggtgtggagcagaggccagagaagaaagatggcccaggagaaccccaagatgcacaacagcgagatcagcaagagactgggcgccgagtggaagctgctgagcgagaccgagaagagacccttcatcgacgaggccaagagactgagagccctgcacatgaaggagcaccccgactacaagtacagacccagaagaaagaccaagaccctgatgaagaaggacaagtacaccctgcccggcggcctgctggcccccggcggcaacagcatggccagcggcgtgggcgtgggcgccggcctgggcgccggcgtgaaccagagaatggacagctacgcccacatgaacggctggagcaacggcagctacagcatgatgcaggaccagctgggctacccccagcaccccggcctgaacgcccacggcgccgcccagatgcagcccatgcacagatacgacgtgagcgccctgcagtacaacagcatgaccagcagccagacctacatgaacggcagccccacctacagcatgagctacagccagcagggcacccccggcatggccctgggcagcatgggcagcgtggtgaagagcgaggccagcagcagcccccccgtggtgaccagcagcagccacagcagagccccctgccaggccggcgacctgagagacatgatcagcatgtacctgcccggcgccgaggtgcccgagcccgccgcccccagcagactgcacatgagccagcactaccagagcggccccgtgcccggcaccgccatcaacggcaccctgcccctgagccacatgtag

SEQ ID NO: 2212 - DNA, 954 bp, Artificial Sequence; identical to SEQ ID NO: 2211
  Description of Artificial Sequence: Synthetic coding sequence

SEQ ID NO: 2213 - DNA, 1182 bp, Artificial Sequence
  Description of Artificial Sequence: Synthetic coding sequence
atgcaccaggccggctaccccggctgcagaggcgccatggccgagagccacctgctgcagtggctgctgctgctgctgcccaccctgtgcggccccggcaccgccgcctggaccaccagcagcctggcctgcgcccagggccccgagttctggtgccagagcctggagcaggccctgcagtgcagagccctgggccactgcctgcaggaggtgtggggccacgtgggcgccgacgacctgtgccaggagtgcgaggacatcgtgcacatcctgaacaagatggccaaggaggccatcttccaggacaccatgagaaagttcctggagcaggagtgcaacgtgctgcccctgaagctgctgatgccccagtgcaaccaggtgctggacgactacttccccctggtgatcgactacttccagaaccagaccgacagcaacggcatctgcatgcacctgggcctgtgcaagagcagacagcccgagcccgagcaggagcccggcatgagcgaccccctgcccaagcccctgagagaccccctgcccgaccccctgctggacaagctggtgctgcccgtgctgcccggcgccctgcaggccagacccggcccccacacccaggacctgagcgagcagcagttccccatccccctgccctactgctggctgtgcagagccctgatcaagagaatccaggccatgatccccaagggcgccctggccgtggccgtggcccaggtgtgcagagtggtgcccctggtggccggcggcatctgccagtgcctggccgagagatacagcgtgatcctgctggacaccctgctgggcagaatgctgccccagctggtgtgcagactggtgctgagatgcagcatggacgacagcgccggccccagaagccccaccggcgagtggctgcccagagacagcgagtgccacctgtgcatgagcgtgaccacccaggccggcaacagcagcgagcaggccatcccccaggccatgctgcaggcctgcgtgggcagctggctggacagagagaagtgcaagcagttcgtggagcagcacaccccccagctgctgaccctggtgcccagaggctgggacgcccacaccacctgccaggccctgggcgtgtgcggcaccatgagcagccccctgcagtgcatccacagccccgacctgtag

SEQ ID NO: 2214 - DNA, 1182 bp, Artificial Sequence; identical to SEQ ID NO: 2213
  Description of Artificial Sequence: Synthetic coding sequence

SEQ ID NO: 2215 - DNA, 1050 bp, Artificial Sequence
  Description of Artificial Sequence: Synthetic coding sequence
atggccgagagccacctgctgcagtggctgctgctgctgctgcccaccctgtgcggccccggcaccgccgcctggaccaccagcagcctggcctgcgcccagggccccgagttctggtgccagagcctggagcaggccctgcagtgcagagccctgggccactgcctgcaggacaccatgagaaagttcctggagcaggagtgcaacgtgctgcccctgaagctgctgatgccccagtgcaaccaggtgctggacgactacttccccctggtgatcgactacttccagaaccagaccgacagcaacggcatctgcatgcacctgggcctgtgcaagagcagacagcccgagcccgagcaggagcccggcatgagcgaccccctgcccaagcccctgagagaccccctgcccgaccccctgctggacaagctggtgctgcccgtgctgcccggcgccctgcaggccagacccggcccccacacccaggacctgagcgagcagcagttccccatccccctgccctactgctggctgtgcagagccctgatcaagagaatccaggccatgatccccaagggcgccctggccgtggccgtggcccaggtgtgcagagtggtgcccctggtggccggcggcatctgccagtgcctggccgagagatacagcgtgatcctgctggacaccctgctgggcagaatgctgccccagctggtgtgcagactggtgctgagatgcagcatggacgacagcgccggccccagaagccccaccggcgagtggctgcccagagacagcgagtgccacctgtgcatgagcgtgaccacccaggccggcaacagcagcgagcaggccatcccccaggccatgctgcaggcctgcgtgggcagctggctggacagagagaagtgcaagcagttcgtggagcagcacaccccccagctgctgaccctggtgcccagaggctgggacgcccacaccacctgccaggccctgggcgtgtgcggcaccatgagcagccccctgcagtgcatccacagccccgacctgtag

SEQ ID NO: 2216 - DNA, 1152 bp, Artificial Sequence
  Description of Artificial Sequence: Synthetic coding sequence
ggcgccatggccgagagccacctgctgcagtggctgctgctgctgctgcccaccctgtgcggccccggcaccgccgcctggaccaccagcagcctggcctgcgcccagggccccgagttctggtgccagagcctggagcaggccctgcagtgcagagccctgggccactgcctgcaggaggtgtggggccacgtgggcgccgacgacctgtgccaggagtgcgaggacatcgtgcacatcctgaacaagatggccaaggaggccatcttccaggacaccatgagaaagttcctggagcaggagtgcaacgtgctgcccctgaagctgctgatgccccagtgcaaccaggtgctggacgactacttccccctggtgatcgactacttccagaaccagaccgacagcaacggcatctgcatgcacctgggcctgtgcaagagcagacagcccgagcccgagcaggagcccggcatgagcgaccccctgcccaagcccctgagagaccccctgcccgaccccctgctggacaagctggtgctgcccgtgctgcccggcgccctgcaggccagacccggcccccacacccaggacctgagcgagcagcagttccccatccccctgccctactgctggctgtgcagagccctgatcaagagaatccaggccatgatccccaagggcgccctggccgtggccgtggcccaggtgtgcagagtggtgcccctggtggccggcggcatctgccagtgcctggccgagagatacagcgtgatcctgctggacaccctgctgggcagaatgctgccccagctggtgtgcagactggtgctgagatgcagcatggacgacagcgccggccccagaagccccaccggcgagtggctgcccagagacagcgagtgccacctgtgcatgagcgtgaccacccaggccggcaacagcagcgagcaggccatcccccaggccatgctgcaggcctgcgtgggcagctggctggacagagagaagtgcaagcagttcgtggagcagcacaccccccagctgctgaccctggtgcccagaggctgggacgcccacaccacctgccaggccctgggcgtgtgcggcaccatgagcagccccctgcagtgcatccacagccccgacctgtag

SEQ ID NO: 2217 - DNA, 1728 bp, Artificial Sequence
  Description of Artificial Sequence: Synthetic coding sequence
atgctgggcgtgctggtgctgggcgccctggccctggccggcctgggcttccccgcccccgccgagccccagcccggcggcagccagtgcgtggagcacgactgcttcgccctgtaccccggccccgccaccttcctgaacgccagccagatctgcgacggcctgagaggccacctgatgaccgtgagaagcagcgtggccgccgacgtgatcagcctgctgctgaacggcgacggcggcgtgggcagaagaagactgtggatcggcctgcagctgccccccggctgcggcgaccccaagagactgggccccctgagaggcttccagtgggtgaccggcgacaacaacaccagctacagcagatgggccagactggacctgaacggcgcccccctgtgcggccccctgtgcgtggccgtgagcgccgccgaggccaccgtgcccagcgagcccatctgggaggagcagcagtgcgaggtgaaggccgacggcttcctgtgcgagttccacttccccgccacctgcagacccctggccgtggagcccggcgccgccgccgccgccgtgagcatcacctacggcacccccttcgccgccagaggcgccgacttccaggccctgcccgtgggcagcagcgccgccgtggcccccctgggcctgcagctgatgtgcaccgccccccccggcgccgtgcagggccactgggccagagaggcccccggcgcctgggactgcagcgtggagaacggcggctgcgagcacgcctgcaacgccatccccggcgcccccagatgccagtgccccgccggcgccgccctgcaggccgacggcagaagctgcaccgccagcgccacccagagctgcaacgacctgtgcgagcacttctgcgtgcccaaccccgaccagcccggcagctacagctgcatgtgcgagaccggctacagactggccgccgaccagcacagatgcgaggacgtggacgactgcatcctggagcccagcccctgcccccagagatgcgtgaacacccagggcggcttcgagtgccactgctaccccaactacgacctggtggacggcgagtgcgtggagcccgtggacccctgcttcagagccaactgcgagtaccagtgccagcccctgaaccagaccagctacctgtgcgtgtgcgccgagggcttcgcccccatcccccacgagccccacagatgccagatgttctgcaaccagaccgcctgccccgccgactgcgaccccaacacccaggccagctgcgagtgccccgagggctacatcctggacgacggcttcatctgcaccgacatcgacgagtgcgagaacggcggcttctgcagcggcgtgtgccacaacctgcccggcaccttcgagtgcatctgcggccccgacagcgccctggccagacacatcggcaccgactgcgacagcggcaaggtggacggcggcgacagcggcagcggcgagcccccccccagccccacccccggcagcaccctgaccccccccgccgtgggcctggtgcacagcggcctgctgatcggcatcagcatcgccagcctgtgcctggtggtggccctgctggccctgctgtgccacctgagaaagaagcagggcgccgccagagccaagatggagtacaagtgcgccgcccccagcaaggaggtggtgctgcagcacgtgagaaccgagagaaccccccagagactgtag

SEQ ID NO: 2218 - DNA, 1674 bp, Artificial Sequence
  Description of Artificial Sequence: Synthetic coding sequence
atgagcgaggccgccagccagggcctgagagccgccgccagaagcgtgtgggccggcaccgacagaagaggctgcagacacagaagacccgtgcccctgtgcagcggcaccgccctgagccagtgccccagattccccagaagactgcacgccgccagactgggcaacatgctgggcgtgctggtgctgggcgccctggccctggccggcctgggcttccccgcccccggctgcggcgaccccaagagactgggccccctgagaggcttccagtgggtgaccggcgacaacaacaccagctacagcagatgggccagactggacctgaacggcgcccccctgtgcggccccctgtgcgtggccgtgagcgccgccgaggccaccgtgcccagcgagcccatctgggaggagcagcagtgcgaggtgaaggccgacggcttcctgtgcgagttccacttccccgccacctgcagacccctggccgtggagcccggcgccgccgccgccgccgtgagcatcacctacggcacccccttcgccgccagaggcgccgacttccaggccctgcccgtgggcagcagcgccgccgtggcccccctgggcctgcagctgatgtgcaccgccccccccggcgccgtgcagggccactgggccagagaggcccccggcgcctgggactgcagcgtggagaacggcggctgcgagcacgcctgcaacgccatccccggcgcccccagatgccagtgccccgccggcgccgccctgcaggccgacggcagaagctgcaccgccagcgccacccagagctgcaacgacctgtgcgagcacttctgcgtgcccaaccccgaccagcccggcagctacagctgcatgtgcgagaccggctacagactggccgccgaccagcacagatgcgaggacgtggacgactgcatcctggagcccagcccctgcccccagagatgcgtgaacacccagggcggcttcgagtgccactgctaccccaactacgacctggtggacggcgagtgcgtggagcccgtggacccctgcttcagagccaactgcgagtaccagtgccagcccctgaaccagaccagctacctgtgcgtgtgcgccgagggcttcgcccccatcccccacgagccccacagatgccagatgttctgcaaccagaccgcctgccccgccgactgcgaccccaacacccaggccagctgcgagtgccccgagggctacatcctggacgacggcttcatctgcaccgacatcgacgagtgcgagaacggcggcttctgcagcggcgtgtgccacaacctgcccggcaccttcgagtgcatctgcggccccgacagcgccctggccagacacatcggcaccgactgcgacagcggcaaggtggacggcggcgacagcggcagcggcgagcccccccccagccccacccccggcagcaccctgaccccccccgccgtgggcctggtgcacagcggcctgctgatcggcatcagcatcgccagcctgtgcctggtggtggccctgctggccctgctgtgccacctgagaaagaagcagggcgccgccagagccaagatggagtacaagtgcgccgcccccagcaaggaggtggtgctgcagcacgtgagaaccgagagaaccccccagagactgtag

SEQ ID NO: 2219 - DNA, 1062 bp, Artificial Sequence
  Description of Artificial Sequence: Synthetic coding sequence
atggagctgaccgagctgctgctggtggtgatgctgctgctgaccgccagactgaccctgagcagccccgccccccccgcctgcgacctgagagtgctgagcaagctgctgagagacagccacgtgctgcacagcagactgagccagtgccccgaggtgcaccccctgcccacccccgtgctgctgcccgccgtggacttcagcctgggcgagtggaagacccagatggaggagaccaaggcccaggacatcctgggcgccgtgaccctgctgctggagggcgtgatggccgccagaggccagctgggccccacctgcctgagcagcctgctgggccagctgagcggccaggtgagactgctgctgggcgccctgcagagcctgctgggcacccagctgcccccccagggcagaaccaccgcccacaaggaccccaacgccatcttcctgagcttccagcacctgctgagaggcaaggtgagattcctgatgctggtgggcggcagcaccctgtgcgtgagaagagccccccccaccaccgccgtgcccagcagaaccagcctggtgctgaccctgaacgagctgcccaacagaaccagcggcctgctggagaccaacttcaccgccagcgccagaaccaccggcagcggcctgctgaagtggcagcagggcttcagagccaagatccccggcctgctgaaccagaccagcagaagcctggaccagatccccggctacctgaacagaatccacgagctgctgaacggcaccagaggcctgttccccggccccagcagaagaaccctgggcgcccccgacatcagcagcggcaccagcgacaccggcagcctgccccccaacctgcagcccggctacagccccagccccacccacccccccaccggccagtacaccctgttccccctgccccccaccctgcccacccccgtggtgcagctgcaccccctgctgcccgaccccagcgcccccacccccacccccaccagccccctgctgaacaccagctacacccacagccagaacctgagccaggagggctag

SEQ ID NO: 2220 - DNA, 945 bp, Artificial Sequence
  Description of Artificial Sequence: Synthetic coding sequence
atggagctgaccgagctgctgctggtggtgatgctgctgctgaccgccagactgaccctgagcagccccgccccccccgcctgcgacctgagagtgctgagcaagctgctgagagacagccacgtgctgcacagcagactgagccagtgccccgaggtgcaccccctgcccacccccgtgctgctgcccgccgtggacttcagcctgggcgagtggaagacccagatggaggagaccaaggcccaggacatcctgggcgccgtgaccctgctgctggagggcgtgatggccgccagaggccagctgggccccacctgcctgagcagcctgctgggccagctgagcggccaggtgagactgctgctgggcgccctgcagagcctgctgggcacccagctgcccccccagggcagaaccaccgcccacaaggaccccaacgccatcttcctgagcttccagcacctgctgagaggcaagaccagcggcctgctggagaccaacttcaccgccagcgccagaaccaccggcagcggcctgctgaagtggcagcagggcttcagagccaagatccccggcctgctgaaccagaccagcagaagcctggaccagatccccggctacctgaacagaatccacgagctgctgaacggcaccagaggcctgttccccggccccagcagaagaaccctgggcgcccccgacatcagcagcggcaccagcgacaccggcagcctgccccccaacctgcagcccggctacagccccagccccacccacccccccaccggccagtacaccctgttccccctgccccccaccctgcccacccccgtggtgcagctgcaccccctgctgcccgaccccagcgcccccacccccacccccaccagccccctgctgaacaccagctacacccacagccagaacctgagccaggagggctag

SEQ ID NO: 2221 - DNA, 861 bp, Artificial Sequence
  Description of Artificial Sequence: Synthetic coding sequence
atggagctgaccgagctgctgctggtggtgatgctgctgctgaccgccagactgaccctgagcagccccgccccccccgcctgcgacctgagagtgctgagcaagctgctgagagacagccacgtgctgcacagcagactgagccagtgccccgaggtgcaccccctgcccacccccgtgctgctgcccgccgtggacttcagcctgggcgagtggaagacccagatggaggagaccaaggcccaggacatcctgggcgccgtgaccctgctgctggagggcgtgatggccgccagaggccagctgggccccacctgcctgagcagcctgctgggccagctgagcggccaggtgagactgctgctgggcgccctgcagagcctgctgggcacccagctgcccccccagggcagaaccaccgcccacaaggaccccaacgccatcttcctgagcttccagcacctgctgagaggcaaggacttctggatcgtgggcgacaagctgcactgcctgagccagaactactggctgtgggccagcgaggtggccgccggcatccagagccaggacagctggagcgccgagcccaacctgcaggtgcccggccccaaccccagaatccccgagcaggacaccagaaccctggagtggaacagctggaccctgagctggaccctgacccaggaccccagaagccccggccacttcctgagaaacatcagacacagactgcccgccacccagccccccgcctggatcttcagcttccccaaccccagcagctactggaccgtgtacgccctgcccagcagcacccacctggcccacccctgcggccccgcccccccccccgccagctag

SEQ ID NO: 2222 - DNA, 1050 bp, Artificial Sequence
  Description of Artificial Sequence: Synthetic coding sequence
atggagctgaccgagctgctgctggtggtgatgctgctgctgaccgccagactgaccctgagcagccccgccccccccgcctgcgacctgagagtgctgagcaagctgctgagagacagccacgtgctgcacagcagactgagccagtgccccgaggtgcaccccctgcccacccccgtgctgctgcccgccgtggacttcagcctgggcgagtggaagacccagatggaggagaccaaggcccaggacatcctgggcgccgtgaccctgctgctggagggcgtgatggccgccagaggccagctgggccccacctgcctgagcagcctgctgggccagctgagcggccaggtgagactgctgctgggcgccctgcagagcctgctgggcacccagggcagaaccaccgcccacaaggaccccaacgccatcttcctgagcttccagcacctgctgagaggcaaggtgagattcctgatgctggtgggcggcagcaccctgtgcgtgagaagagccccccccaccaccgccgtgcccagcagaaccagcctggtgctgaccctgaacgagctgcccaacagaaccagcggcctgctggagaccaacttcaccgccagcgccagaaccaccggcagcggcctgctgaagtggcagcagggcttcagagccaagatccccggcctgctgaaccagaccagcagaagcctggaccagatccccggctacctgaacagaatccacgagctgctgaacggcaccagaggcctgttccccggccccagcagaagaaccctgggcgcccccgacatcagcagcggcaccagcgacaccggcagcctgccccccaacctgcagcccggctacagccccagccccacccacccccccaccggccagtacaccctgttccccctgccccccaccctgcccacccccgtggtgcagctgcaccccctgctgcccgaccccagcgcccccacccccacccccaccagccccctgctgaacaccagctacacccacagccagaacctgagccaggagggctag

SEQ ID NO: 2223 - DNA, 963 bp, Artificial Sequence
  Description of Artificial Sequence: Synthetic coding sequence
atgcccatgtaccaggtgaagccctaccacggcggcggcgcccccctgagagtggagctgcccacctgcatgtacagactgcccaacgtgcacggcagaagctacggccccgcccccggcgccggccacgtgcaggaggagagcaacctgagcctgcaggccctggagagcagacaggacgacatcctgaagagactgtacgagctgaaggccgccgtggacggcctgagcaagatgatccagacccccgacgccgacctggacgtgaccaacatcatccaggccgacgagcccaccaccctgaccaccaacgccctggacctgaacagcgtgctgggcaaggactacggcgccctgaaggacatcgtgatcaacgccaaccccgccagcccccccctgagcctgctggtgctgcacagactgctgtgcgagcacttcagagtgctgagcaccgtgcacacccacagcagcgtgaagagcgtgcccgagaacctgctgaagtgcttcggcgagcagaacaagaagcagcccagacaggactaccagctgggcttcaccctgatctggaagaacgtgcccaagacccagatgaagttcagcatccagaccatgtgccccatcgagggcgagggcaacatcgccagattcctgttcagcctgttcggccagaagcacaacgccgtgaacgccaccctgatcgacagctgggtggacatcgccatcttccagctgaaggagggcagcagcaaggagaaggccgccgtgttcagaagcatgaacagcgccctgggcaagagcccctggctggccggcaacgagctgaccgtggccgacgtggtgctgtggagcgtgctgcagcagatcggcggctgcagcgtgaccgtgcccgccaacgtgcagagatggatgagaagctgcgagaacctggcccccttcaacaccgccctgaagctgctgaagtag

SEQ ID NO: 2224 - DNA, 1068 bp, Artificial Sequence
  Description of Artificial Sequence: Synthetic coding sequence
atggagagactgtggggcctgttccagagagcccagcagctgagccccagaagcagccagaccgtgtaccagagagtggagggccccagaaagggccacctggaggaggaggaggaggacggcgaggagggcgccgagaccctggcccacttctgccccatggagctgagaggccccgagcccctgggcagcagacccagacagcccaacctgatcccctgggccgccgccggcagaagagccgccccctacctggtgctgaccgccctgctgatcttcaccggcgccttcctgctgggctacgtggccttcagaggcagctgccaggcctgcggcgacagcgtgctggtggtgagcgaggacgtgaactacgagcccgacctggacttccaccagggcagactgtactggagcgacctgcaggccatgttcctgcagttcctgggcgagggcagactggaggacaccatcagacagaccagcctgagagagagagtggccggcagcgccggcatggccgccctgacccaggacatcagagccgccctgagcagacagaagctggaccacgtgtggaccgacacccactacgtgggcctgcagttccccgaccccgcccaccccaacaccctgcactgggtggacgaggccggcaaggtgggcgagcagctgcccctggaggaccccgacgtgtactgcccctacagcgccatcggcaacgtgaccggcgagctggtgtacgcccactacggcagacccgaggacctgcaggacctgagagccagaggcgtggaccccgtgggcagactgctgctggtgagagtgggcgtgatcagcttcgcccagaaggaggcccagagaccctgcggcccccccagaatggccggcgagccccccagactgcccctgagccccggccccagagccaccaccgccgccagcggccagcagagccaggacctgcacccccaccagcagcacctgagactgcacagaagacccctgagagccagaagcctgagatgccacagaggccccgagggctgcatgggccccagaagcagctag

SEQ ID NO: 2225 - DNA, 2406 bp, Artificial Sequence
  Description of Artificial Sequence: Synthetic coding sequence
atggagagactgtggggcctgttccagagagcccagcagctgagccccagaagcagccagaccgtgtaccagagagtggagggccccagaaagggccacctggaggaggaggaggaggacggcgaggagggcgccgagaccctggcccacttctgccccatggagctgagaggccccgagcccctgggcagcagacccagacagcccaacctgatcccctgggccgccgccggcagaagagccgccccctacctggtgctgaccgccctgctgatcttcaccggcgccttcctgctgggctacgtggccttcagaggcagctgccaggcctgcggcgacagcgtgctggtggtgagcgaggacgtgaactacgagcccgacctggacttccaccagggcagactgtactggagcgacctgcaggccatgttcctgcagttcctgggcgagggcagactggaggacaccatcagacagaccagcctgagagagagagtggccggcagcgccggcatggccgccctgacccaggacatcagagccgccctgagcagacagaagctggaccacgtgtggaccgacacccactacgtgggcctgcagttccccgaccccgcccaccccaacaccctgcactgggtggacgaggccggcaaggtgggcgagcagctgcccctggaggaccccgacgtgtactgcccctacagcgccatcggcaacgtgaccggcgagctggtgtacgcccactacggcagacccgaggacctgcaggacctgagagccagaggcgtggaccccgtgggcagactgctgctggtgagagtgggcgtgatcagcttcgcccagaaggtgaccaacgcccaggacttcggcgcccagggcgtgctgatctaccccgagcccgccgacttcagccaggacccccccaagcccagcctgagcagccagcaggccgtgtacggccacgtgcacctgggcaccggcgacccctacacccccggcttccccagcttcaaccagacccagttcccccccgtggccagcagcggcctgcccagcatccccgcccagcccatcagcgccgacatcgccagcagactgctgagaaagctgaagggccccgtggccccccaggagtggcagggcagcctgctgggcagcccctaccacctgggccccggccccagactgagactggtggtgaacaaccacagaaccagcacccccatcaacaacatcttcggctgcatcgagggcagaagcgagcccgaccactacgtggtgatcggcgcccagagagacgcctggggccccggcgccgccaagagcgccgtgggcaccgccatcctgctggagctggtgagaaccttcagcagcatggtgagcaacggcttcagacccagaagaagcctgctgttcatcagctgggacggcggcgacttcggcagcgtgggcagcaccgagtggctggagggctacctgagcgtgctgcacctgaaggccgtggtgtacgtgagcctggacaacgccgtgctgggcgacgacaagttccacgccaagaccagccccctgctgaccagcctgatcgagagcgtgctgaagcaggtggacagccccaaccacagcggccagaccctgtacgagcaggtggtgttcaccaaccccagctgggacgccgaggtgatcagacccctgcccatggacagcagcgcctacagcttcaccgccttcgtgggcgtgcccgccgtggagttcagcttcatggaggacgaccaggcctaccccttcctgcacaccaaggaggacacctacgagaacctgcacaaggtgctgcagggcagactgcccgccgtggcccaggccgtggcccagctggccggccagctgctgatcagactgagccacgacagactgctgcccctggacttcggcagatacggcgacgtggtgctgagacacatcggcaacctgaacgagttcagcggcgacctgaaggccagaggcctgaccctgcagtgggtgtacagcgccagaggcgactacatcagagccgccgagaagctgagacaggagatctacagcagcgaggagagagacgagagactgaccagaatgtacaacgtgagaatcatgagagtggagttctacttcctgagccagtacgtgagccccgccgacagccccttcagacacatcttcatgggcagaggcgaccacaccctgggcgccctgctggaccacctgagactgctgagaagcaacagcagcggcacccccggcgccaccagcagcaccggcttccaggagagcagattcagaagacagctggccctgctgacctggaccctgcagggcgccgccaacgccctgagcggcgacgtgtggaacatcgacaacaacttctag

SEQ ID NO: 2226 - DNA, 1029 bp, Artificial Sequence
  Description of Artificial Sequence: Synthetic coding sequence
atggtgagcaacggcttcagacccagaagaagcctgctgttcatcagctgggacggcggcgacttcggcagcgtgggcagcaccgagtggctggagggctacctgagcgtgctgcacctgaaggccgtggtgtacgtgagcctggacaacgccgtgctgggcgacgacaagttccacgccaagaccagccccctgctgaccagcctgatcgagagcgtgctgaagcaggtggacagccccaaccacagcggccagaccctgtacgagcaggtggtgttcaccaaccccagctgggacgccgaggtgatcagacccctgcccatggacagcagcgcctacagcttcaccgccttcgtgggcgtgcccgccgtggagttcagcttcatggaggacgaccaggcctaccccttcctgcacaccaaggaggacacctacgagaacctgcacaaggtgctgcagggcagactgcccgccgtggcccaggccgtggcccagctggccggccagctgctgatcagactgagccacgacagactgctgcccctggacttcggcagatacggcgacgtggtgctgagacacatcggcaacctgaacgagttcagcggcgacctgaaggccagaggcctgaccctgcagtgggtgtacagcgccagaggcgactacatcagagccgccgagaagctgagacaggagatctacagcagcgaggagagagacgagagactgaccagaatgtacaacgtgagaatcatgagagtggagttctacttcctgagccagtacgtgagccccgccgacagccccttcagacacatcttcatgggcagaggcgaccacaccctgggcgccctgctggaccacctgagactgctgagaagcaacagcagcggcacccccggcgccaccagcagcaccggcttccaggagagcagattcagaagacagctggccctgctgacctggaccctgcagggcgccgccaacgccctgagcggcgacgtgtggaacatcgacaacaacttctag

SEQ ID NO: 2227 - DNA, 1596 bp, Artificial Sequence
  Description of Artificial Sequence: Synthetic coding sequence
atggccgccaccctggacctgaagagcaaggaggagaaggacgccgagctggacaagagaatcgaggccctgagaagaaagaacgaggccctgatcagaagataccaggagatcgaggaggacagaaagaaggccgagctggagggcgtggccgtgaccgcccccagaaagggcagaagcgtggagaaggagaacgtggccgtggagagcgagaagaacctgggccccagcagaagaagccccggcacccccagaccccccggcgccagcaagggcggcagaacccccccccagcagggcggcagagccggcatgggcagagccagcagaagctgggagggcagccccggcgagcagcccagaggcggcggcgccggcggcagaggcagaagaggcagaggcagaggcagcccccacctgagcggcgccggcgacaccagcatcagcgacagaaagagcaaggagtgggaggagagaagaagacagaacatcgagaagatgaacgaggagatggagaagatcgccgagtacgagagaaaccagagagagggcgtgctggagcccaaccccgtgagaaacttcctggacgaccccagaagaagaagcggccccctggaggagagcgagagagacagaagagaggagagcagaagacacggcagaaactggggcggccccgacttcgagagagtgagatgcggcctggagcacgagagacagggcagaagagccggcctgggcagcgccggcgacatgaccctgagcatgaccggcagagagagaagcgagtacctgagatggaagcaggagagagagaagatcgaccaggagagactgcagagacacagaaagcccaccggccagtggagaagagagtgggacgccgagaagaccgacggcatgttcaaggacggccccgtgcccgcccacgagcccagccacagatacgacgaccaggcctgggccagaccccccaagccccccaccttcggcgagttcctgagccagcacaaggccgaggccagcagcagaagaagaagaaagagcagcagaccccaggccaaggccgcccccagagcctacagcgaccacgacgacagatgggagaccaaggagggcgccgccagccccgcccccgagaccccccagcccaccagccccgagaccagccccaaggagacccccatgcagccccccgagatccccgcccccgcccacagaccccccgaggacgagggcgaggagaacgagggcgaggaggacgaggagtgggaggacatcagcgaggacgaggaggaggaggagatcgaggtggaggagggcgacgaggaggagcccgcccaggaccaccaggcccccgaggccgcccccaccggcatcccctgcagcgagcaggcccacggcgtgcccttcagccccgaggagcccctgctggagccccaggcccccggcacccccagcagccccttcagcccccccagcggccaccagcccgtgagcgactggggcgaggaggtggagctgaacagccccagaaccacccacctggccggcgccctgagccccggcgaggcctggcccttcgagagcgtgtag

SEQ ID NO: 2228 - DNA, 1329 bp, Artificial Sequence
  Description of Artificial Sequence: Synthetic coding sequence
atgcactactgcgtgctgagcgccttcctgatcctgcacctggtgaccgtggccctgagcctgagcacctgcagcaccctggacatggaccagttcatgagaaagagaatcgaggccatcagaggccagatcctgagcaagctgaagctgaccagcccccccgaggactaccccgagcccgaggaggtgccccccgaggtgatcagcatctacaacagcaccagagacctgctgcaggagaaggccagcagaagagccgccgcctgcgagagagagagaagcgacgaggagtactacgccaaggaggtgtacaagatcgacatgccccccttcttccccagcgagaccgtgtgccccgtggtgaccacccccagcggcagcgtgggcagcctgtgcagcagacagagccaggtgctgtgcggctacctggacgccatcccccccaccttctacagaccctacttcagaatcgtgagattcgacgtgagcgccatggagaagaacgccagcaacctggtgaaggccgagttcagagtgttcagactgcagaaccccaaggccagagtgcccgagcagagaatcgagctgtaccagatcctgaagagcaaggacctgaccagccccacccagagatacatcgacagcaaggtggtgaagaccagagccgagggcgagtggctgagcttcgacgtgaccgacgccgtgcacgagtggctgcaccacaaggacagaaacctgggcttcaagatcagcctgcactgcccctgctgcaccttcgtgcccagcaacaactacatcatccccaacaagagcgaggagctggaggccagattcgccggcatcgacggcaccagcacctacaccagcggcgaccagaagaccatcaagagcaccagaaagaagaacagcggcaagaccccccacctgctgctgatgctgctgcccagctacagactggagagccagcagaccaacagaagaaagaagagagccctggacgccgcctactgcttcagaaacgtgcaggacaactgctgcctgagacccctgtacatcgacttcaagagagacctgggctggaagtggatccacgagcccaagggctacaacgccaacttctgcgccggcgcctgcccctacctgtggagcagcgacacccagcacagcagagtgctgagcctgtacaacaccatcaaccccgaggccagcgccagcccctgctgcgtgagccaggacctggagcccctgaccatcctgtactacatcggcaagacccccaagatcgagcagctgagcaacatgatcgtgaagagctgcaagtgcagctag

SEQ ID NO: 2229 - DNA, 1245 bp, Artificial Sequence
  Description of Artificial Sequence: Synthetic coding sequence
atgcactactgcgtgctgagcgccttcctgatcctgcacctggtgaccgtggccctgagcctgagcacctgcagcaccctggacatggaccagttcatgagaaagagaatcgaggccatcagaggccagatcctgagcaagctgaagctgaccagcccccccgaggactaccccgagcccgaggaggtgccccccgaggtgatcagcatctacaacagcaccagagacctgctgcaggagaaggccagcagaagagccgccgcctgcgagagagagagaagcgacgaggagtactacgccaaggaggtgtacaagatcgacatgccccccttcttccccagcgagaacgccatcccccccaccttctacagaccctacttcagaatcgtgagattcgacgtgagcgccatggagaagaacgccagcaacctggtgaaggccgagttcagagtgttcagactgcagaaccccaaggccagagtgcccgagcagagaatcgagctgtaccagatcctgaagagcaaggacctgaccagccccacccagagatacatcgacagcaaggtggtgaagaccagagccgagggcgagtggctgagcttcgacgtgaccgacgccgtgcacgagtggctgcaccacaaggacagaaacctgggcttcaagatcagcctgcactgcccctgctgcaccttcgtgcccagcaacaactacatcatccccaacaagagcgaggagctggaggccagattcgccggcatcgacggcaccagcacctacaccagcggcgaccagaagaccatcaagagcaccagaaagaagaacagcggcaagaccccccacctgctgctgatgctgctgcccagctacagactggagagccagcagaccaacagaagaaagaagagagccctggacgccgcctactgcttcagaaacgtgcaggacaactgctgcctgagacccctgtacatcgacttcaagagagacctgggctggaagtggatccacgagcccaagggctacaacgccaacttctgcgccggcgcctgcccctacctgtggagcagcgacacccagcacagcagagtgctgagcctgtacaacaccatcaaccccgaggccagcgccagcccctgctgcgtgagccaggacctggagcccctgaccatcctgtactacatcggcaagacccccaagatcgagcagctgagcaacatgatcgtgaagagctgcaagtgcagctag

SEQ ID NO: 2230 - DNA, 1239 bp, Artificial Sequence
  Description of Artificial Sequence: Synthetic coding sequence
atgaagatgcacctgcagagagccctggtggtgctggccctgctgaacttcgccaccgtgagcctgagcctgagcacctgcaccaccctggacttcggccacatcaagaagaagagagtggaggccatcagaggccagatcctgagcaagctgagactgaccagcccccccgagcccaccgtgatgacccacgtgccctaccaggtgctggccctgtacaacagcaccagagagctgctggaggagatgcacggcgagagagaggagggctgcacccaggagaacaccgagagcgagtactacgccaaggagatccacaagttcgacatgatccagggcctggccgagcacaacgagctggccgtgtgccccaagggcatcaccagcaaggtgttcagattcaacgtgagcagcgtggagaagaacagaaccaacctgttcagagccgagttcagagtgctgagagtgcccaaccccagcagcaagagaaacgagcagagaatcgagctgttccagatcctgagacccgacgagcacatcgccaagcagagatacatcggcggcaagaacctgcccaccagaggcaccgccgagtggctgagcttcgacgtgaccgacaccgtgagagagtggctgctgagaagagagagcaacctgggcctggagatcagcatccactgcccctgccacaccttccagcccaacggcgacatcctggagaacatccacgaggtgatggagatcaagttcaagggcgtggacaacgaggacgaccacggcagaggcgacctgggcagactgaagaagcagaaggaccaccacaacccccacctgatcctgatgatgatccccccccacagactggacaaccccggccagggcggccagagaaagaagagagccctggacaccaactactgcttcagaaacctggaggagaactgctgcgtgagacccctgtacatcgacttcagacaggacctgggctggaagtgggtgcacgagcccaagggctactacgccaacttctgcagcggcccctgcccctacctgagaagcgccgacaccacccacagcaccgtgctgggcctgtacaacaccctgaaccccgaggccagcgccagcccctgctgcgtgccccaggacctggagcccctgaccatcctgtactacgtgggcagaacccccaaggtggagcagctgagcaacatggtggtgaagagctgcaagtgcagctag

SEQ ID NO: 2231 - DNA, 930 bp, Artificial Sequence
  Description of Artificial Sequence: Synthetic coding sequence
atgaagatgcacctgcagagagccctggtggtgctggccctgctgaacttcgccaccgtgagcctgagcctgagcacctgcaccaccctggacttcggccacatcaagaagaagagagtggaggccatcagaggccagatcctgagcaagctgagactgaccagcccccccgagcccaccgtgatgacccacgtgccctaccaggtgctggccctgtacaacagcaccagagagctgctggaggagatgcacggcgagagagaggagggctgcacccaggagaacaccgagagcgagtactacgccaaggagatccacaagttcgacatgatccagggcctggccgagcacaacgagctggccgtgtgccccaagggcatcaccagcaaggtgttcagattcaacgtgagcagcgtggagaagaacagaaccaacctgttcagagccgagttcagagtgctgagagtgcccaaccccagcagcaagagaaacgagcagagaatcgagctgttccagatcctgagacccgacgagcacatcgccaagcagagatacatcggcggcaagaacctgcccaccagaggcaccgccgagtggctgagcttcgacgtgaccgacaccgtgagagagtggctgctgagaagagagagcaacctgggcctggagatcagcatccactgcccctgccacaccttccagcccaacggcgacatcctggagaacatccacgaggtgatggagatcaagttcaagggcgtggacaacgaggacgaccacggcagaggcgacctgggcagactgaagaagcagaaggaccaccacaacccccacctgatcctgatgatgatccccccccacagactggacaaccccggccagggcggccagagaaagaagagagccctggacaccaactactgcttcagatag

SEQ ID NO: 2232 - DNA, 444 bp, Artificial Sequence
  Description of Artificial Sequence: Synthetic coding sequence
atggccagccacagactgctgctgctgtgcctggccggcctggtgttcgtgagcgaggccggccccaccggcaccggcgagagcaagtgccccctgatggtgaaggtgctggacgccgtgagaggcagccccgccatcaacgtggccgtgcacgtgttcagaaaggccgccgacgacacctgggagcccttcgccagcggcaagaccagcgagagcggcgagctgcacggcctgaccaccgaggaggagttcgtggagggcatctacaaggtggagatcgacaccaagagctactggaaggccctgggcatcagccccttccacgagcacgccgaggtggtgttcaccgccaacgacagcggccccagaagatacaccatcgccgccctgctgagcccctacagctacagcaccaccgccgtggtgaccaaccccaaggagtag

SEQ ID NO: 2233 - DNA, 555 bp, Artificial Sequence
  Description of Artificial Sequence: Synthetic coding sequence
atggccagccacagactgctgctgctgtgcctggccggcctggtgttcgtgagcgaggccggccccaccggcaccggcgagagcaagtgccccctgatggtgaaggtgctggacgccgtgagaggcagccccgccatcaacgtggccgtgcacgtgttcagaaaggccgccgacgacacctgggagcccttcgccagcggcaagaccagcgagagcggcgagctgcacggcctgaccaccgaggaggagttcgtggagggcatctacaaggtggagatcgacaccaagagctactggaaggccctgggcatcagccccttccacgagcacgccgaggtgagcatccagaccttcgaggccttccaggagatcctgtacaagaagaagttcaccaccctgtggcactggaccagcggcggccagagcttcttcagagccctggtggaggtggtgttcaccgccaacgacagcggccccagaagatacaccatcgccgccctgctgagcccctacagctacagcaccaccgccgtggtgaccaaccccaaggagtag

SEQ ID NO: 2234 - DNA, 420 bp, Artificial Sequence
  Description of Artificial Sequence: Synthetic coding sequence
atggccagccacagactgctgctgctgtgcctggccggcctggtgttcgtgagcgaggccggccccaccggcaccggcgagagcaagtgccccctgatggtgaaggtgctggacgccgtgagaggcagccccgccatcaacgtggccgtgcacgtgttcagaaaggccgccgacgacacctgggagcccttcgccagcggcaagaccagcgagagcggcgagctgcacggcctgaccaccgaggaggagttcgtggagggcatctacaaggtggagatcgacaccaagagctactggaaggccctgggcatcagccccttccacgagcacgccgaggtggtgttcaccgccaacgacagcggccccagaagatactacagctacagcaccaccgccgtggtgaccaaccccaaggagtag

SEQ ID NO: 2235 - DNA, 996 bp, Artificial Sequence
  Description of Artificial Sequence: Synthetic coding sequence
atgaacggcaccagaaactggtgcaccctggtggacgtgcaccccgaggaccaggccgccgtgtacctgaagggcagaagcggcgacaagatgatccacgagaagaacatcaaccagctgaagagcgaggtgcagtacatccaggaggccagaaactgcctgcagaagctgagagaggacatcagcagcaagctggacagaaacctgggcgacagcctgcacagacaggagatccaggtggtgctggagaagcccaacggcttcagccagagccccaccgccctgtacagcagcccccccgaggtggacacctgcatcaacgaggacgtggagagcctgagaaagaccgtgcaggacctgctggccaagctgcaggaggccaagagacagcaccagagcgactgcgtggccttcgaggtgaccctgagcagataccagagagaggccgagcagagcaacgtggccctgcagagagaggaggacagagtggagcagaaggaggccgaggtgggcgagctgcagagaagactgctgggcatggagaccgagcaccaggccctgctggccaaggtgagagagggcgaggtggccctggaggagctgagaagcaacaacgccgactgccaggccgagagagagaaggccgccaccctggagaaggaggtggccggcctgagagagaagatccaccacctggacgacatgctgaagagccagcagagaaaggtgagacagatgatcgagcagctgcagaacagcaaggccgtgatccagagcaaggacgccaccatccaggagctgaaggagaagatcgcctacctggaggccgagaacctggagatgcacgacagaatggagcacctgatcgagaagcagatcagccacggcaacttcagcacccaggccagagccaagaccgagaaccccggcagcatcagaatcagcaagccccccagccccaagcccatgcccgtgatcagagtggtggagacctag

SEQ ID NO: 2236 - DNA, 1098 bp, Artificial Sequence
  Description of Artificial Sequence: Synthetic coding sequence
atgaacggcaccagaaactggtgcaccctggtggacgtgcaccccgaggaccaggccgccgccggcagaaagacctacgccatggtgagcagccacagcgccggccacagcctggccagcgagctggtggagagccacgacggccacgaggagatcatcaaggtgtacctgaagggcagaagcggcgacaagatgatccacgagaagaacatcaaccagctgaagagcgaggtgcagtacatccaggaggccagaaactgcctgcagaagctgagagaggacatcagcagcaagctggacagaaacctgggcgacagcctgcacagacaggagatccaggtggtgctggagaagcccaacggcttcagccagagccccaccgccctgtacagcagcccccccgaggtggacacctgcatcaacgaggacgtggagagcctgagaaagaccgtgcaggacctgctggccaagctgcaggaggccaagagacagcaccagagcgactgcgtggccttcgaggtgaccctgagcagataccagagagaggccgagcagagcaacgtggccctgcagagagaggaggacagagtggagcagaaggaggccgaggtgggcgagctgcagagaagactgctgggcatggagaccgagcaccaggccctgctggccaaggtgagagagggcgaggtggccctggaggagctgagaagcaacaacgccgactgccaggccgagagagagaaggccgccaccctggagaaggaggtggccggcctgagagagaagatccaccacctggacgacatgctgaagagccagcagagaaaggtgagacagatgatcgagcagctgcagaacagcaaggccgtgatccagagcaaggacgccaccatccaggagctgaaggagaagatcgcctacctggaggccgagaacctggagatgcacgacagaatggagcacctgatcgagaagcagatcagccacggcaacttcagcacccaggccagagccaagaccgagaaccccggcagcatcagaatcagcaagccccccagccccaagcccatgcccgtgatcagagtggtggagacctag

SEQ ID NO: 2237 - DNA, 1173 bp, Artificial Sequence
  Description of Artificial Sequence: Synthetic coding sequence
atgaacggcaccagaaactggtgcaccctggtggacgtgcaccccgaggaccaggccgccggcagcgtggacatcctgagactgaccctgcagggcgagctgaccggcgacgagctggagcacatcgcccagaaggccggcagaaagacctacgccatggtgagcagccacagcgccggccacagcctggccagcgagctggtggagagccacgacggccacgaggagatcatcaaggtgtacctgaagggcagaagcggcgacaagatgatccacgagaagaacatcaaccagctgaagagcgaggtgcagtacatccaggaggccagaaactgcctgcagaagctgagagaggacatcagcagcaagctggacagaaacctgggcgacagcctgcacagacaggagatccaggtggtgctggagaagcccaacggcttcagccagagccccaccgccctgtacagcagcccccccgaggtggacacctgcatcaacgaggacgtggagagcctgagaaagaccgtgcaggacctgctggccaagctgcaggaggccaagagacagcaccagagcgactgcgtggccttcgaggtgaccctgagcagataccagagagaggccgagcagagcaacgtggccctgcagagagaggaggacagagtggagcagaaggaggccgaggtgggcgagctgcagagaagactgctgggcatggagaccgagcaccaggccctgctggccaaggtgagagagggcgaggtggccctggaggagctgagaagcaacaacgccgactgccaggccgagagagagaaggccgccaccctggagaaggaggtggccggcctgagagagaagatccaccacctggacgacatgctgaagagccagcagagaaaggtgagacagatgatcgagcagctgcagaacagcaaggccgtgatccagagcaaggacgccaccatccaggagctgaaggagaagatcgcctacctggaggccgagaacctggagatgcacgacagaatggagcacctgatcgagaagcagatcagccacggcaacttcagcacccaggccagagccaagaccgagaaccccggcagcatcagaatcagcaagccccccagccccaagcccatgcccgtgatcagagtggtggagacctag

SEQ ID NO: 2238 - DNA, 600 bp, Artificial Sequence
  Description of Artificial Sequence: Synthetic coding sequence
atgaacggcaccagaaactggtgcaccctggtggacgtgcaccccgaggaccaggccgccgccggcagaaagacctacgccatggtgagcagccacagcgccggccacagcctggccagcgagctggtggagagccacgacggccacgaggagatcatcaaggtgtacctgaagggcagaagcggcgacaagatgatccacgagaagaacatcaaccagctgaagagcgaggtgcagtacatccaggaggccagaaactgcctgcagaagctgagagaggacatcagcagcaagctggacagaaacctgggcgacagcctgcacagacaggagatccaggtggtgctggagaagcccaacggcttcagccagagccccaccgccctgtacagcagcccccccgaggtggacacctgcatcaacgaggacgtggagagcctgagaaagaccgtgcaggacctgctggccaagctgcaggaggccaagagacagcaccagagcgactgcgtggccttcgaggtgaccctgagcagataccagagagaggccgagcagagcaacgtggccctgcagagagaggaggacagatgccccgagtag

SEQ ID NO: 2239 - DNA, 1230 bp, Artificial Sequence
  Description of Artificial Sequence: Synthetic coding sequence
atgagcagccccggcatgaccagcctgcagctggagaaggaggagtgcatgcagtgcgtgccctgcagccccagaaccagagtggccctgctggagctgtacagagccatgtgccagggcagcgtggacatcctgagactgaccctgcagggcgagctgaccggcgacgagctggagcacatcgcccagaaggccggcagaaagacctacgccatggtgagcagccacagcgccggccacagcctggccagcgagctggtggagagccacgacggccacgaggagatcatcaaggtgtacctgaagggcagaagcggcgacaagatgatccacgagaagaacatcaaccagctgaagagcgaggtgcagtacatccaggaggccagaaactgcctgcagaagctgagagaggacatcagcagcaagctggacagaaacctgggcgacagcctgcacagacaggagatccaggtggtgctggagaagcccaacggcttcagccagagccccaccgccctgtacagcagcccccccgaggtggacacctgcatcaacgaggacgtggagagcctgagaaagaccgtgcaggacctgctggccaagctgcaggaggccaagagacagcaccagagcgactgcgtggccttcgaggtgaccctgagcagataccagagagaggccgagcagagcaacgtggccctgcagagagaggaggacagagtggagcagaaggaggccgaggtgggcgagctgcagagaagactgctgggcatggagaccgagcaccaggccctgctggccaaggtgagagagggcgaggtggccctggaggagctgagaagcaacaacgccgactgccaggccgagagagagaaggccgccaccctggagaaggaggtggccggcctgagagagaagatccaccacctggacgacatgctgaagagccagcagagaaaggtgagacagatgatcgagcagctgcagaacagcaaggccgtgatccagagcaaggacgccaccatccaggagctgaaggagaagatcgcctacctggaggccgagaacctggagatgcacgacagaatggagcacctgatcgagaagcagatcagccacggcaacttcagcacccaggccagagccaagaccgagaaccccggcagcatcagaatcagcaagccccccagccccaagcccatgcccgtgatcagagtggtggagacctag

SEQ ID NO: 2240 - DNA, 543 bp, Artificial Sequence
  Description of Artificial Sequence: Synthetic coding sequence
atgaacggcaccagaaactggtgcaccctggtggacgtgcaccccgaggaccaggccgccgccggcagaaagacctacgccatggtgagcagccacagcgccggccacagcctggccagcgagctggtggagagccacgacggccacgaggagatcatcaaggtgtacctgaagggcagaagcggcgacaagatgatccacgagaagaacatcaaccagctgaagagcgaggtgcagtacatccaggaggccagaaactgcctgcagaagctgagagaggacatcagcagcaagctggacagaaacctgggcgacagcctgcacagacaggagatccaggtggtgctggagaagcccaacggcttcagccagagccccaccgccctgaaggccggcgacaccgacgtgcagagcgactggagaatgagctggggcaacgaggtgcccagcaccaacaccgcccagttcctggccaccaactgcctgttcttctacctgctgcacctgcagcccaccctgccctggccccccgccgacagatag

SEQ ID NO: 2241 - DNA, 1182 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggcccccagaatgcccgaggccgccccccccgtggcccccgcccccgccgcccccacccccgccgcccccgcccccgcccccagctggcccctgagcagcagcgtgcccagccagaagacctaccagggcagctacggcttcagactgggcttcctgcacagcggcaccgccaagagcgtgacctgcacctacagccccgccctgaacaagatgttctgccagctggccaagacctgccccgtgcagctgtgggtggacagcacccccccccccggcaccagagtgagagccatggccatctacaagcagagccagcacatgaccgaggtggtgagaagatgcccccaccacgagagatgcagcgacagcgacggcctggcccccccccagcacctgatcagagtggagggcaacctgagagtggagtacctggacgacagaaacaccttcagacacagcgtggtggtgccctacgagccccccgaggtgggcagcgactgcaccaccatccactacaactacatgtgcaacagcagctgcatgggcggcatgaacagaagacccatcctgaccatcatcaccctggaggacagcagcggcaacctgctgggcagaaacagcttcgaggtgagagtgtgcgcctgccccggcagagacagaagaaccgaggaggagaacctgagaaagaagggcgagccccaccacgagctgccccccggcagcaccaagagagccctgcccaacaacaccagcagcagcccccagcccaagaagaagcccctggacggcgagtacttcaccctgcagatcagaggcagagagagattcgagatgttcagagagctgaacgaggccctggagctgaaggacgcccaggccggcaaggagcccggcggcagcagagcccacagcagccacctgaagagcaagaagggccagagcaccagcagacacaagaagctgatgttcaagaccgagggccccgacagcgactag

SEQ ID NO: 2242 - DNA, 1032 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggcccccagaatgcccgaggccgccccccccgtggcccccgcccccgccgcccccacccccgccgcccccgcccccgcccccagctggcccctgagcagcagcgtgcccagccagaagacctaccagggcagctacggcttcagactgggcttcctgcacagcggcaccgccaagagcgtgacctgcacctacagccccgccctgaacaagatgttctgccagctggccaagacctgccccgtgcagctgtgggtggacagcacccccccccccggcaccagagtgagagccatggccatctacaagcagagccagcacatgaccgaggtggtgagaagatgcccccaccacgagagatgcagcgacagcgacggcctggcccccccccagcacctgatcagagtggagggcaacctgagagtggagtacctggacgacagaaacaccttcagacacagcgtggtggtgccctacgagccccccgaggtgggcagcgactgcaccaccatccactacaactacatgtgcaacagcagctgcatgggcggcatgaacagaagacccatcctgaccatcatcaccctggaggacagcagcggcaacctgctgggcagaaacagcttcgaggtgagagtgtgcgcctgccccggcagagacagaagaaccgaggaggagaacctgagaaagaagggcgagccccaccacgagctgccccccggcagcaccaagagagccctgcccaacaacaccagcagcagcccccagcccaagaagaagcccctggacggcgagtacttcaccctgcagaagaccttccccgccagacacggcggcagccacctgtag

SEQ ID NO: 2243 - DNA, 1149 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggcccccagaatgcccgaggccgccccccccgtggcccccgcccccgccgcccccacccccgccgcccccgcccccgcccccagctggcccctgagcagcagcgtgcccagccagaagacctaccagggcagctacggcttcagactgacctgcacctacagccccgccctgaacaagatgttctgccagctggccaagacctgccccgtgcagctgtgggtggacagcacccccccccccggcaccagagtgagagccatggccatctacaagcagagccagcacatgaccgaggtggtgagaagatgcccccaccacgagagatgcagcgacagcgacggcctggcccccccccagcacctgatcagagtggagggcaacctgagagtggagtacctggacgacagaaacaccttcagacacagcgtggtggtgccctacgagccccccgaggtgggcagcgactgcaccaccatccactacaactacatgtgcaacagcagctgcatgggcggcatgaacagaagacccatcctgaccatcatcaccctggaggacagcagcggcaacctgctgggcagaaacagcttcgaggtgagagtgtgcgcctgccccggcagagacagaagaaccgaggaggagaacctgagaaagaagggcgagccccaccacgagctgccccccggcagcaccaagagagccctgcccaacaacaccagcagcagcccccagcccaagaagaagcccctggacggcgagtacttcaccctgcagatcagaggcagagagagattcgagatgttcagagagctgaacgaggccctggagctgaaggacgcccaggccggcaaggagcccggcggcagcagagcccacagcagccacctgaagagcaagaagggccagagcaccagcagacacaagaagctgatgttcaagaccgagggccccgacagcgactag

SEQ ID NO: 2244 - DNA, 858 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggcccccagaatgcccgaggccgccccccccgtggcccccgcccccgccgcccccacccccgccgcccccgcccccgcccccagctggcccctgagcagcagcgtgcccagccagaagacctaccagggcagctacggcttcagactgggcttcctgcacagcggcaccgccaagagcgtgacctgcacctacagccccgccctgaacaagatgttctgccagctggccaagacctgccccgtgcagctgtgggtggacagcacccccccccccggcaccagagtgagagccatggccatctacaagcagagccagcacatgaccgaggtggtgagaagatgcccccaccacgagagatgcagcgacagcgacggcctggcccccccccagcacctgatcagagtggagggcaacctgagagtggagtacctggacgacagaaacaccttcagacacagcgtggtggtgccctacgagccccccgaggtgggcagcgactgcaccaccatccactacaactacatgtgcaacagcagctgcatgggcggcatgaacagaagacccatcctgaccatcatcaccctggaggacagcagacccagacaggtggaccacctgagaagcggcgtgcaggacagcctggccaacatcgccaagagccacctgtactag

SEQ ID NO: 2245 - DNA, 273 bp, Artificial Sequence
  Description of Artificial Sequence: Synthetic coding sequence
atgttctgccagctggccaagacctgccccgtgcagctgtgggtggacagcacccccccccccggcaccagagtgagagccatggccatctacaagcagagccagcacatgaccgaggtggtgagaagatgcccccaccacgagagatgcagcgacagcgacggcctggcccccccccagcacctgatcagagtggagggcaacctgagagtggagtacctggacgacagaaacaccttcagacacagcgtggtgagcggcagaagaggctag

SEQ ID NO: 2246 - DNA, 135 bp, Artificial Sequence
  Description of Artificial Sequence: Synthetic coding sequence
cccctgcccagccagagaagaaaccactggatggagaacatcagccccttcagccacctgaagagcaagaagggccagagcaccagcagacacaagaagctgatgttcaagaccgagggccccgacagcgactag

SEQ ID NO: 2247 - DNA, 1026 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggcccccagaatgcccgaggccgccccccccgtggcccccgcccccgccgcccccacccccgccgcccccgcccccgcccccagctggcccctgagcagcagcgtgcccagccagaagacctaccagggcagctacggcttcagactgggcttcctgcacagcggcaccgccaagagcgtgacctgcacctacagccccgccctgaacaagatgttctgccagctggccaagacctgccccgtgcagctgtgggtggacagcacccccccccccggcaccagagtgagagccatggccatctacaagcagagccagcacatgaccgaggtggtgagaagatgcccccaccacgagagatgcagcgacagcgacggcctggcccccccccagcacctgatcagagtggagggcaacctgagagtggagtacctggacgacagaaacaccttcagacacagcgtggtggtgccctacgagccccccgaggtgggcagcgactgcaccaccatccactacaactacatgtgcaacagcagctgcatgggcggcatgaacagaagacccatcctgaccatcatcaccctggaggacagcagcggcaacctgctgggcagaaacagcttcgaggtgagagtgtgcgcctgccccggcagagacagaagaaccgaggaggagaacctgagaaagaagggcgagccccaccacgagctgccccccggcagcaccaagagagccctgcccaacaacaccagcagcagcccccagcccaagaagaagcccctggacggcgagtacttcaccctgcaggaccagaccagcttccagaaggagaactgctag

SEQ ID NO: 2248 - DNA, 1182 bp, Artificial Sequence; identical to SEQ ID NO: 2241
  Description of Artificial Sequence: Synthetic coding sequence

SEQ ID NO: 2249 - DNA, 1041 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggcccccagaatgcccgaggccgccccccccgtggcccccgcccccgccgcccccacccccgccgcccccgcccccgcccccagctggcccctgagcagcagcgtgcccagccagaagacctaccagggcagctacggcttcagactgggcttcctgcacagcggcaccgccaagagcgtgacctgcacctacagccccgccctgaacaagatgttctgccagctggccaagacctgccccgtgcagctgtgggtggacagcacccccccccccggcaccagagtgagagccatggccatctacaagcagagccagcacatgaccgaggtggtgagaagatgcccccaccacgagagatgcagcgacagcgacggcctggcccccccccagcacctgatcagagtggagggcaacctgagagtggagtacctggacgacagaaacaccttcagacacagcgtggtggtgccctacgagccccccgaggtgggcagcgactgcaccaccatccactacaactacatgtgcaacagcagctgcatgggcggcatgaacagaagacccatcctgaccatcatcaccctggaggacagcagcggcaacctgctgggcagaaacagcttcgaggtgagagtgtgcgcctgccccggcagagacagaagaaccgaggaggagaacctgagaaagaagggcgagccccaccacgagctgccccccggcagcaccaagagagccctgcccaacaacaccagcagcagcccccagcccaagaagaagcccctggacggcgagtacttcaccctgcagatgctgctggacctgagatggtgctacttcctgatcaacagcagctag

SEQ ID NO: 2250 - DNA, 387 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggcccccagaatgcccgaggccgccccccccgtggcccccgcccccgccgcccccacccccgccgcccccgcccccgcccccagctggcccctgagcagcagcgtgcccagccagaagacctaccagggcagctacggcttcagactgggcttcctgcacagcggcaccgccaagagcgtgacctgcacctacagcccctag

SEQ ID NO: 2251 - DNA, 498 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgagccccctgcccagccaggccatggacgacctgatgctgagccccgacgacatcgagcagtggttcaccgaggaccccggccccgacgaggcccccagaatgcccgaggccgccccccccgtggcccccgcccccgccgcccccacccccgccgcccccgcccccgcccccagctggcccctgagcagcagcgtgcccagccagaagacctaccagggcagctacggcttcagactgggcttcctgcacagcggcaccgccaagagcgtgacctgcacctacagccccgccctgaacaagatgttctgccagctggccaagacctgccccgtgcagctgtgggtggacagcacccccccccccggcaccagagtgagagccatggccatctacaagcagtag

SEQ ID NO: 2252 - DNA, 600 bp, Artificial Sequence
  Description of Artificial Sequence: Synthetic coding sequence
atgttctgccagctggccaagacctgccccgtgcagctgtgggtggacagcacccccccccccggcaccagagtgagagccatggccatctacaagcagagccagcacatgaccgaggtggtgagaagatgcccccaccacgagagatgcagcgacagcgacggcctggcccccccccagcacctgatcagagtggagggcaacctgagagtggagtacctggacgacagaaacaccttcagacacagcgtggtggtgccctacgagccccccgaggtgggcagcgactgcaccaccatccactacaactacatgtgcaacagcagctgcatgggcggcatgaacagaagacccatcctgaccatcatcaccctggaggacagcagcggcaacctgctgggcagaaacagcttcgaggtgagagtgtgcgcctgccccggcagagacagaagaaccgaggaggagaacctgagaaagaagggcgagccccaccacgagctgccccccggcagcaccaagagagccctgcccaacaacaccagcagcagcccccagcccaagaagaagcccctggacggcgagtacttcaccctgcagtag

SEQ ID NO: 2253 - DNA, 468 bp, Artificial Sequence
  Description of Artificial Sequence: Synthetic coding sequence
atggaggagccccagagcgaccccagcgtggagccccccctgagccaggagaccttcagcgacctgtggaagctgctgcccgagaacaacgtgctgtacagccccgccctgaacaagatgttctgccagctggccaagacctgccccgtgcagctgtgggtggacagcacccccccccccggcaccagagtgagagccatggccatctacaagcagagccagcacatgaccgaggtggtgagaagatgcccccaccacgagagatgcagcgacagcgacggcctggcccccccccagcacctgatcagagtggagggcaacctgagagtggagtacctggacgacagaaacaccttcagacacagcgtggtggtgccctacgagccccccgaggtgggcagcgactgcaccaccatccactacaactacatgtgcaacagcagctgcatgggcggcatgaacagatag

SEQ ID NO: 2254 - DNA, 468 bp, Artificial Sequence; identical to SEQ ID NO: 2253
  Description of Artificial Sequence: Synthetic coding sequence

SEQ ID NO: 2255 - DNA, 1590 bp, Artificial Sequence
  Description of Artificial Sequence: Synthetic coding sequence
atgctgctggccgtgctgtactgcctgctgtggagcttccagaccagcgccggccacttccccagagcctgcgtgagcagcaagaacctgatggagaaggagtgctgccccccctggagcggcgacagaagcccctgcggccagctgagcggcagaggcagctgccagaacatcctgctgagcaacgcccccctgggcccccagttccccttcaccggcgtggacgacagagagagctggcccagcgtgttctacaacagaacctgccagtgcagcggcaacttcatgggcttcaactgcggcaactgcaagttcggcttctggggccccaactgcaccgagagaagactgctggtgagaagaaacatcttcgacctgagcgcccccgagaaggacaagttcttcgcctacctgaccctggccaagcacaccatcagcagcgactacgtgatccccatcggcacctacggccagatgaagaacggcagcacccccatgttcaacgacatcaacatctacgacctgttcgtgtggatgcactactacgtgagcatggacgccctgctgggcggcagcgagatctggagagacatcgacttcgcccacgaggcccccgccttcctgccctggcacagactgttcctgctgagatgggagcaggagatccagaagctgaccggcgacgagaacttcaccatcccctactgggactggagagacgccgagaagtgcgacatctgcaccgacgagtacatgggcggccagcaccccaccaaccccaacctgctgagccccgccagcttcttcagcagctggcagatcgtgtgcagcagactggaggagtacaacagccaccagagcctgtgcaacggcacccccgagggccccctgagaagaaaccccggcaaccacgacaagagcagaacccccagactgcccagcagcgccgacgtggagttctgcctgagcctgacccagtacgagagcggcagcatggacaaggccgccaacttcagcttcagaaacaccctggagggcttcgccagccccctgaccggcatcgccgacgccagccagagcagcatgcacaacgccctgcacatctacatgaacggcaccatgagccaggtgcagggcagcgccaacgaccccatcttcctgctgcaccacgccttcgtggacagcatcttcgagcagtggctgagaagacacagacccctgcaggaggtgtaccccgaggccaacgcccccatcggccacaacagagagagctacatggtgcccttcatccccctgtacagaaacggcgacttcttcatcagcagcaaggacctgggctacgactacagctacctgcaggacagcgaccccgacagcttccaggactacatcaagagctacctggagcaggccagcagaatctggagctggctgctgggcgccgccatggtgggcgccgtgctgaccgccctgctggccggcctggtgagcctgctgtgcagacacaagagaaagcagctgcccgaggagaagcagcccctgctgatggagaaggaggactaccacagcctgtaccagagccacctgtag

SEQ ID NO: 2256 - DNA, 1365 bp, Artificial Sequence
  Description of Artificial Sequence: Synthetic coding sequence
atggacccctacatgatccagatgagcagcaagggcaacctgcccagcatcctggacgtgcacgtgaacgtgggcggcagaagcagcgtgcccggcaagatgaagggcagaaaggccagatggagcgtgagacccagcgacatggccaagaagaccttcaaccccatcagagccatcgtggacaacatgaaggtgaagcccaaccccaacaagaccatgatcagcctgagcatcggcgaccccaccgtgttcggcaacctgcccaccgaccccgaggtgacccaggccatgaaggacgccctggacagcggcaagtacaacggctacgcccccagcatcggcttcctgagcagcagagaggagatcgccagctactaccactgccccgaggcccccctggaggccaaggacgtgatcctgaccagcggctgcagccaggccatcgacctgtgcctggccgtgctggccaaccccggccagaacatcctggtgcccagacccggcttcagcctgtacaagaccctggccgagagcatgggcatcgaggtgaagctgtacaacctgctgcccgagaagagctgggagatcgacctgaagcagctggagtacctgatcgacgagaagaccgcctgcctgatcgtgaacaaccccagcaacccctgcggcagcgtgttcagcaagagacacctgcagaagatcctggccgtggccgccagacagtgcgtgcccatcctggccgacgagatctacggcgacatggtgttcagcgactgcaagtacgagcccctggccaccctgagcaccgacgtgcccatcctgagctgcggcggcctggccaagagatggctggtgcccggctggagactgggctggatcctgatccacgacagaagagacatcttcggcaacgagatcagagacggcctggtgaagctgagccagagaatcctgggcccctgcaccatcgtgcagggcgccctgaagagcatcctgtgcagaacccccggcgagttctaccacaacaccctgagcttcctgaagagcaacgccgacctgtgctacggcgccctggccgccatccccggcctgagacccgtgagacccagcggcgccatgtacctgatggtgggcatcgagatggagcacttccccgagttcgagaacgacgtggagttcaccgagagactggtggccgagcagagcgtgcactgcctgcccgccacctgcttcgagtaccccaacttcatcagagtggtgatcaccgtgcccgaggtgatgatgctggaggcctgcagcagaatccaggagttctgcgagcagcactaccactgcgccgagggcagccaggaggagtgcgacaagtag

SEQ ID NO: 2257 - DNA, 1602 bp, Artificial Sequence
  Description of Artificial Sequence: Synthetic coding sequence
atggccgtggagagccagggcggcagacccctggtgctgggcctgctgctgtgcgtgctgggccccgtggtgagccacgccggcaagatcctgctgatccccgtggacggcagccactggctgagcatgctgggcgccatccagcagctgcagcagagaggccacgagatcgtggtgctggcccccgacgccagcctgtacatcagagacggcgccttctacaccctgaagacctaccccgtgcccttccagagagaggacgtgaaggagagcttcgtgagcctgggccacaacgtgttcgagaacgacagcttcctgcagagagtgatcaagacctacaagaagatcaagaaggacagcgccatgctgctgagcggctgcagccacctgctgcacaacaaggagctgatggccagcctggccgagagcagcttcgacgtgatgctgaccgaccccttcctgccctgcagccccatcgtggcccagtacctgagcctgcccaccgtgttcttcctgcacgccctgccctgcagcctggagttcgaggccacccagtgccccaaccccttcagctacgtgcccagacccctgagcagccacagcgaccacatgaccttcctgcagagagtgaagaacatgctgatcgccttcagccagaacttcctgtgcgacgtggtgtacagcccctacgccaccctggccagcgagttcctgcagagagaggtgaccgtgcaggacctgctgagcagcgccagcgtgtggctgttcagaagcgacttcgtgaaggactaccccagacccatcatgcccaacatggtgttcgtgggcggcatcaactgcctgcaccagaaccccctgagccaggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 2258 - DNA, 1335 bp, Artificial Sequence
  Description of Artificial Sequence: Synthetic coding sequence
atggccgtggagagccagggcggcagacccctggtgctgggcctgctgctgtgcgtgctgggccccgtggtgagccacgccggcaagatcctgctgatccccgtggacggcagccactggctgagcatgctgggcgccatccagcagctgcagcagagaggccacgagatcgtggtgctggcccccgacgccagcctgtacatcagagacggcgccttctacaccctgaagacctaccccgtgcccttccagagagaggacgtgaaggagagcttcgtgagcctgggccacaacgtgttcgagaacgacagcttcctgcagagagtgatcaagacctacaagaagatcaagaaggacagcgccatgctgctgagcggctgcagccacctgctgcacaacaaggagctgatggccagcctggccgagagcagcttcgacgtgatgctgaccgaccccttcctgccctgcagccccatcgtggcccagtacctgagcctgcccaccgtgttcttcctgcacgccctgccctgcagcctggagttcgaggccacccagtgccccaaccccttcagctacgtgcccagacccctgagcagccacagcgaccacatgaccttcctgcagagagtgaagaacatgctgatcgccttcagccagaacttcctgtgcgacgtggtgtacagcccctacgccaccctggccagcgagttcctgcagagagaggtgaccgtgcaggacctgctgagcagcgccagcgtgtggctgttcagaagcgacttcgtgaaggactaccccagacccatcatgcccaacatggtgttcgtgggcggcatcaactgcctgcaccagaaccccctgagccaggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagaaagaagcagcagagcggcagacagatgtag

SEQ ID NO: 2259 - DNA, 1593 bp, Artificial Sequence
  Description of Artificial Sequence: Synthetic coding sequence
atggccagagccggctggaccagccccgtgcccctgtgcgtgtgcctgctgctgacctgcggcttcgccgaggccggcaagctgctggtggtgcccatggacggcagccactggttcaccatgcagagcgtggtggagaagctgatcctgagaggccacgaggtggtggtggtgatgcccgaggtgagctggcagctggagagaagcctgaactgcaccgtgaagacctacagcaccagctacaccctggaggaccagaacagagagttcatggtgttcgcccacgcccagtggaaggcccaggcccagagcatcttcagcctgctgatgagcagcagcagcggcttcctggacctgttcttcagccactgcagaagcctgttcaacgacagaaagctggtggagtacctgaaggagagcagcttcgacgccgtgttcctggaccccttcgacacctgcggcctgatcgtggccaagtacttcagcctgcccagcgtggtgttcaccagaggcatcttctgccaccacctggaggagggcgcccagtgccccgcccccctgagctacgtgcccaacgacctgctgggcttcagcgacgccatgaccttcaaggagagagtgtggaaccacatcgtgcacctggaggaccacctgttctgccagtacctgttcagaaacgccctggagatcgccagcgagatcctgcagacccccgtgaccgcctacgacctgtacagccacaccagcatctggctgctgagaaccgacttcgtgctggactaccccaagcccgtgatgcccaacatgatcttcatcggcggcatcaactgccaccagggcaagcccctgcccatggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 2260 - DNA, 1605 bp, Artificial Sequence
  Description of Artificial Sequence: Synthetic coding sequence
atggccaccggcctgcaggtgcccctgccctggctggccaccggcctgctgctgctgctgagcgtgcagccctgggccgagagcggcaaggtgctggtggtgcccatcgacggcagccactggctgagcatgagagaggtgctgagagagctgcacgccagaggccaccaggccgtggtgctgacccccgaggtgaacatgcacatcaaggaggagaacttcttcaccctgaccacctacgccatcagctggacccaggacgagttcgacagacacgtgctgggccacacccagctgtacttcgagaccgagcacttcctgaagaagttcttcagaagcatggccatgctgaacaacatgagcctggtgtaccacagaagctgcgtggagctgctgcacaacgaggccctgatcagacacctgaacgccaccagcttcgacgtggtgctgaccgaccccgtgaacctgtgcgccgccgtgctggccaagtacctgagcatccccaccgtgttcttcctgagaaacatcccctgcgacctggacttcaagggcacccagtgccccaaccccagcagctacatccccagactgctgaccaccaacagcgaccacatgaccttcatgcagagagtgaagaacatgctgtaccccctggccctgagctacatctgccacgccttcagcgccccctacgccagcctggccagcgagctgttccagagagaggtgagcgtggtggacatcctgagccacgccagcgtgtggctgttcagaggcgacttcgtgatggactaccccagacccatcatgcccaacatggtgttcatcggcggcatcaactgcgccaacagaaagcccctgagccaggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 2261 - DNA, 1470 bp, Artificial Sequence
  Description of Artificial Sequence: Synthetic coding sequence
atggccggccagagagtgctgctgctggtgggcttcctgctgcccggcgtgctgctgagcgaggccgccaagatcctgaccatcagcaccgtggacttcaagaaggaggagaagagctaccaggtgatcagctggctggcccccgaggaccaccagagagagttcaagaagagcttcgacttcttcctggaggagaccctgggcggcagaggcaagttcgagaacctgctgaacgtgctggagtacctggccctgcagtgcagccacttcctgaacagaaaggacatcatggacagcctgaagaacgagaacttcgacatggtgatcgtggagaccttcgactactgccccttcctgatcgccgagaagctgggcaagcccttcgtggccatcctgagcaccagcttcggcagcctggagttcggcctgcccatccccctgagctacgtgcccgtgttcagaagcctgctgaccgaccacatggacttctggggcagagtgaagaacttcctgatgttcttcagcttctgcagaagacagcagcacatgcagagcaccttcgacaacaccatcaaggagcacttcaccgagggcagcagacccgtgctgagccacctgctgctgaaggccgagctgtggttcatcaacagcgacttcgccttcgacttcgccagacccctgctgcccaacaccgtgtacgtgggcggcctgatggagaagcccatcaagcccgtgccccaggacctggagaacttcatcgccaagttcggcgacagcggcttcgtgctggtgaccctgggcagcatggtgaacacctgccagaaccccgagatcttcaaggagatgaacaacgccttcgcccacctgccccagggcgtgatctggaagtgccagtgcagccactggcccaaggacgtgcacctggccgccaacgtgaagatcgtggactggctgccccagagcgacctgctggcccaccccagcatcagactgttcgtgacccacggcggccagaacagcatcatggaggccatccagcacggcgtgcccatggtgggcatccccctgttcggcgaccagcccgagaacatggtgagagtggaggccaagaagttcggcgtgagcatccagctgaagaagctgaaggccgagaccctggccctgaagatgaagcagatcatggaggacaagagatacaagagcgccgccgtggccgccagcgtgatcctgagaagccaccccctgagccccacccagagactggtgggctggatcgaccacgtgctgcagaccggcggcgccacccacctgaagccctacgtgttccagcagccctggcacgagcagtacctgctggacgtgttcgtgttcctgctgggcctgaccctgggcaccctgtggctgtgcggcaagctgctgggcatggccgtgtggtggctgagaggcgccagaaaggtgaaggagacctag

SEQ ID NO: 2262 - DNA, 1572 bp, Artificial Sequence
  Description of Artificial Sequence: Synthetic coding sequence
atggccggccagagagtgctgctgctggtgggcttcctgctgcccggcgtgctgctgagcgaggccgccaagatcctgaccatcagcaccgtgggcggcagccactacctgctgatggacagagtgagccagatcctgcaggaccacggccacaacgtgaccatgctgaaccacaagagaggccccttcatgcccgacttcaagaaggaggagaagagctaccaggtgatcagctggctggcccccgaggaccaccagagagagttcaagaagagcttcgacttcttcctggaggagaccctgggcggcagaggcaagttcgagaacctgctgaacgtgctggagtacctggccctgcagtgcagccacttcctgaacagaaaggacatcatggacagcctgaagaacgagaacttcgacatggtgatcgtggagaccttcgactactgccccttcctgatcgccgagaagctgggcaagcccttcgtggccatcctgagcaccagcttcggcagcctggagttcggcctgcccatccccctgagctacgtgcccgtgttcagaagcctgctgaccgaccacatggacttctggggcagagtgaagaacttcctgatgttcttcagcttctgcagaagacagcagcacatgcagagcaccttcgacaacaccatcaaggagcacttcaccgagggcagcagacccgtgctgagccacctgctgctgaaggccgagctgtggttcatcaacagcgacttcgccttcgacttcgccagacccctgctgcccaacaccgtgtacgtgggcggcctgatggagaagcccatcaagcccgtgccccaggacctggagaacttcatcgccaagttcggcgacagcggcttcgtgctggtgaccctgggcagcatggtgaacacctgccagaaccccgagatcttcaaggagatgaacaacgccttcgcccacctgccccagggcgtgatctggaagtgccagtgcagccactggcccaaggacgtgcacctggccgccaacgtgaagatcgtggactggctgccccagagcgacctgctggcccaccccagcatcagactgttcgtgacccacggcggccagaacagcatcatggaggccatccagcacggcgtgcccatggtgggcatccccctgttcggcgaccagcccgagaacatggtgagagtggaggccaagaagttcggcgtgagcatccagctgaagaagctgaaggccgagaccctggccctgaagatgaagcagatcatggaggacaagagatacaagagcgccgccgtggccgccagcgtgatcctgagaagccaccccctgagccccacccagagactggtgggctggatcgaccacgtgctgcagaccggcggcgccacccacctgaagccctacgtgttccagcagccctggcacgagcagtacctgctggacgtgttcgtgttcctgctgggcctgaccctgggcaccctgtggctgtgcggcaagctgctgggcatggccgtgtggtggctgagaggcgccagaaaggtgaaggagacctag

SEQ ID NO: 2263 - DNA, 417 bp, Artificial Sequence
  Description of Artificial Sequence: Synthetic coding sequence
atggccggccagagagtgctgctgctggtgggcttcctgctgcccggcgtgctgctgagcgaggccgccaagatcctgaccatcagcaccgtgggcggcagccactacctgctgatggacagagtgagccagatcctgcaggaccacggccacaacgtgaccatgctgaaccacaagagaggccccttcatgcccgacttcaagaaggaggagaagagctaccaggtgatcagctggctggcccccgaggaccaccagagagagttcaagaagagcttcgacttcttcctggaggagaccctgggcggcagaggcaagttcgagaacctgctgaacgtgctggagtacctggccctgcagtgcagccacttcctgaacagaaaggacatcatggacagcctgaagaacgagaactag

SEQ ID NO: 2264 - DNA, 666 bp, Artificial Sequence
  Description of Artificial Sequence: Synthetic coding sequence
atggtgaacacctgccagaaccccgagatcttcaaggagatgaacaacgccttcgcccacctgccccagggcgtgatctggaagtgccagtgcagccactggcccaaggacgtgcacctggccgccaacgtgaagatcgtggactggctgccccagagcgacctgctggcccaccccagcatcagactgttcgtgacccacggcggccagaacagcatcatggaggccatccagcacggcgtgcccatggtgggcatccccctgttcggcgaccagcccgagaacatggtgagagtggaggccaagaagttcggcgtgagcatccagctgaagaagctgaaggccgagaccctggccctgaagatgaagcagatcatggaggacaagagatacaagagcgccgccgtggccgccagcgtgatcctgagaagccaccccctgagccccacccagagactggtgggctggatcgaccacgtgctgcagaccggcggcgccacccacctgaagccctacgtgttccagcagccctggcacgagcagtacctgctggacgtgttcgtgttcctgctgggcctgaccctgggcaccctgtggctgtgcggcaagctgctgggcatggccgtgtggtggctgagaggcgccagaaaggtgaaggagacctag

SEQ ID NO: 2265 - DNA, 1086 bp, Artificial Sequence
  Description of Artificial Sequence: Synthetic coding sequence
atggccatgaactacaacgccaaggacgaggtggacggcggccccccctgcgcccccggcggcaccgccaagaccagaagacccgacaacaccgccttcaagcagcagagactgcccgcctggcagcccatcctgaccgccggcaccgtgctgcccatcttcttcatcatcggcctgatcttcatccccatcggcatcggcatcttcgtgaccagcaacaacatcagagagatcgagatcgactacaccggcaccgagcccagcagcccctgcaacaagtgcctgagccccgacgtgaccccctgcttctgcaccatcaacttcaccctggagaagagcttcgagggcaacgtgttcatgtactacggcctgagcaacttctaccagaaccacagaagatacgtgaagagcagagacgacagccagctgaacggcgacagcagcgccctgctgaaccccagcaaggagtgcgagccctacagaagaaacgaggacaagcccatcgccccctgcggcgccatcgccaacagcatgttcaacgacaccctggagctgttcctgatcggcaacgacagctaccccatccccatcgccctgaagaagaagggcatcgcctggtggaccgacaagaacgtgaagttcagaaacccccccggcggcgacaacctggaggagagattcaagggcaccaccaagcccgtgaactggctgaagcccgtgtacatgctggacagcgaccccgacaacaacggcttcatcaacgaggacttcatcgtgtggatgagaaccgccgccctgcccaccttcagaaagctgtacagactgatcgagagaaagagcgacctgcaccccaccctgcccgccggcagatacagcctgaacgtgacctacaactaccccgtgcactacttcgacggcagaaagagaatgatcctgagcaccatcagctggatgggcggcaagaaccccttcctgggcatcgcctacatcgccgtgggcagcatcagcttcctgctgggcgtggtgctgctggtgatcaaccacaagtacagaaacagcagcaacaccgccgacatcaccatctag

SEQ ID NO: 2266 - DNA, 954 bp, Artificial Sequence
  Description of Artificial Sequence: Synthetic coding sequence
ctgaccgacagacagaccgacaccgcccccagccccagctaccacctgctgcccggcagaagaagaaccgtggacgccgccgccagcagaggccagggccccgagcccgcccccggcggcggcgtggagggcgtgggcgccagaggcgtggccctgaagctgttcgtgcagctgctgggctgcagcagattcggcggcgccgtggtgagagccggcgaggccgagcccagcggcgccgccagaagcgccagcagcggcagagaggagccccagcccgaggagggcgaggaggaggaggagaaggaggaggagagaggcccccagtggagactgggcgccagaaagcccggcagctggaccggcgaggccgccgtgtgcgccgacagcgcccccgccgccagagccccccaggccctggccagagccagcggcagaggcggcagagtggccagaagaggcgccgaggagagcggccccccccacagccccagcagaagaggcagcgccagcagagccggccccggcagagccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagatgcgacaagcccagaagatag

SEQ ID NO: 2267 - DNA, 1239 bp, Artificial Sequence
  Description of Artificial Sequence: Synthetic coding sequence
ctgaccgacagacagaccgacaccgcccccagccccagctaccacctgctgcccggcagaagaagaaccgtggacgccgccgccagcagaggccagggccccgagcccgcccccggcggcggcgtggagggcgtgggcgccagaggcgtggccctgaagctgttcgtgcagctgctgggctgcagcagattcggcggcgccgtggtgagagccggcgaggccgagcccagcggcgccgccagaagcgccagcagcggcagagaggagccccagcccgaggagggcgaggaggaggaggagaaggaggaggagagaggcccccagtggagactgggcgccagaaagcccggcagctggaccggcgaggccgccgtgtgcgccgacagcgcccccgccgccagagccccccaggccctggccagagccagcggcagaggcggcagagtggccagaagaggcgccgaggagagcggccccccccacagccccagcagaagaggcagcgccagcagagccggccccggcagagccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaagaagagcgtgagaggcaagggcaagggccagaagagaaagagaaagaagagcagatacaagagctggagcgtgtacgtgggcgccagatgctgcctgatgccctggagcctgcccggcccccacccctgcggcccctgcagcgagagaagaaagcacctgttcgtgcaggacccccagacctgcaagtgcagctgcaagaacaccgacagcagatgcaaggccagacagctggagctgaacgagagaacctgcagatgcgacaagcccagaagatag

SEQ ID NO: 2268 - DNA, 984 bp, Artificial Sequence
  Description of Artificial Sequence: Synthetic coding sequence
ctgaccgacagacagaccgacaccgcccccagccccagctaccacctgctgcccggcagaagaagaaccgtggacgccgccgccagcagaggccagggccccgagcccgcccccggcggcggcgtggagggcgtgggcgccagaggcgtggccctgaagctgttcgtgcagctgctgggctgcagcagattcggcggcgccgtggtgagagccggcgaggccgagcccagcggcgccgccagaagcgccagcagcggcagagaggagccccagcccgaggagggcgaggaggaggaggagaaggaggaggagagaggcccccagtggagactgggcgccagaaagcccggcagctggaccggcgaggccgccgtgtgcgccgacagcgcccccgccgccagagccccccaggccctggccagagccagcggcagaggcggcagagtggccagaagaggcgccgaggagagcggccccccccacagccccagcagaagaggcagcgccagcagagccggccccggcagagccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaagtgcgacaagcccagaagatag

SEQ ID NO: 2269 - DNA, 1116 bp, Artificial Sequence
  Description of Artificial Sequence: Synthetic coding sequence
ctgaccgacagacagaccgacaccgcccccagccccagctaccacctgctgcccggcagaagaagaaccgtggacgccgccgccagcagaggccagggccccgagcccgcccccggcggcggcgtggagggcgtgggcgccagaggcgtggccctgaagctgttcgtgcagctgctgggctgcagcagattcggcggcgccgtggtgagagccggcgaggccgagcccagcggcgccgccagaagcgccagcagcggcagagaggagccccagcccgaggagggcgaggaggaggaggagaaggaggaggagagaggcccccagtggagactgggcgccagaaagcccggcagctggaccggcgaggccgccgtgtgcgccgacagcgcccccgccgccagagccccccaggccctggccagagccagcggcagaggcggcagagtggccagaagaggcgccgaggagagcggccccccccacagccccagcagaagaggcagcgccagcagagccggccccggcagagccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaacccctgcggcccctgcagcgagagaagaaagcacctgttcgtgcaggacccccagacctgcaagtgcagctgcaagaacaccgacagcagatgcaaggccagacagctggagctgaacgagagaacctgcagatgcgacaagcccagaagatag

SEQ ID NO: 2270 - DNA, 444 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaagtgcgacaagcccagaagatag

SEQ ID NO: 2271 - DNA, 1170 bp, Artificial Sequence
  Description of Artificial Sequence: Synthetic coding sequence
ctgaccgacagacagaccgacaccgcccccagccccagctaccacctgctgcccggcagaagaagaaccgtggacgccgccgccagcagaggccagggccccgagcccgcccccggcggcggcgtggagggcgtgggcgccagaggcgtggccctgaagctgttcgtgcagctgctgggctgcagcagattcggcggcgccgtggtgagagccggcgaggccgagcccagcggcgccgccagaagcgccagcagcggcagagaggagccccagcccgaggagggcgaggaggaggaggagaaggaggaggagagaggcccccagtggagactgggcgccagaaagcccggcagctggaccggcgaggccgccgtgtgcgccgacagcgcccccgccgccagagccccccaggccctggccagagccagcggcagaggcggcagagtggccagaagaggcgccgaggagagcggccccccccacagccccagcagaagaggcagcgccagcagagccggccccggcagagccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaagaagagcgtgagaggcaagggcaagggccagaagagaaagagaaagaagagcagaccctgcggcccctgcagcgagagaagaaagcacctgttcgtgcaggacccccagacctgcaagtgcagctgcaagaacaccgacagcagatgcaaggccagacagctggagctgaacgagagaacctgcagatgcgacaagcccagaagatag

SEQ ID NO: 2272 - DNA, 1065 bp, Artificial Sequence
  Description of Artificial Sequence: Synthetic coding sequence
ctgaccgacagacagaccgacaccgcccccagccccagctaccacctgctgcccggcagaagaagaaccgtggacgccgccgccagcagaggccagggccccgagcccgcccccggcggcggcgtggagggcgtgggcgccagaggcgtggccctgaagctgttcgtgcagctgctgggctgcagcagattcggcggcgccgtggtgagagccggcgaggccgagcccagcggcgccgccagaagcgccagcagcggcagagaggagccccagcccgaggagggcgaggaggaggaggagaaggaggaggagagaggcccccagtggagactgggcgccagaaagcccggcagctggaccggcgaggccgccgtgtgcgccgacagcgcccccgccgccagagccccccaggccctggccagagccagcggcagaggcggcagagtggccagaagaggcgccgaggagagcggccccccccacagccccagcagaagaggcagcgccagcagagccggccccggcagagccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaacccctgcggcccctgcagcgagagaagaaagcacctgttcgtgcaggacccccagacctgcaagtgcagctgcaagaacaccgacagcagatgcaagatgtag

SEQ ID NO: 2273 - DNA, 1188 bp, Artificial Sequence
  Description of Artificial Sequence: Synthetic coding sequence
ctgaccgacagacagaccgacaccgcccccagccccagctaccacctgctgcccggcagaagaagaaccgtggacgccgccgccagcagaggccagggccccgagcccgcccccggcggcggcgtggagggcgtgggcgccagaggcgtggccctgaagctgttcgtgcagctgctgggctgcagcagattcggcggcgccgtggtgagagccggcgaggccgagcccagcggcgccgccagaagcgccagcagcggcagagaggagccccagcccgaggagggcgaggaggaggaggagaaggaggaggagagaggcccccagtggagactgggcgccagaaagcccggcagctggaccggcgaggccgccgtgtgcgccgacagcgcccccgccgccagagccccccaggccctggccagagccagcggcagaggcggcagagtggccagaagaggcgccgaggagagcggccccccccacagccccagcagaagaggcagcgccagcagagccggccccggcagagccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaagaagagcgtgagaggcaagggcaagggccagaagagaaagagaaagaagagcagatacaagagctggagcgtgccctgcggcccctgcagcgagagaagaaagcacctgttcgtgcaggacccccagacctgcaagtgcagctgcaagaacaccgacagcagatgcaaggccagacagctggagctgaacgagagaacctgcagatgcgacaagcccagaagatag

SEQ ID NO: 2274 - DNA, 414 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagatgcgacaagcccagaagatag

SEQ ID NO: 2275 - DNA, 1116 bp, Artificial Sequence
  Description of Artificial Sequence: Synthetic coding sequence
ctgaccgacagacagaccgacaccgcccccagccccagctaccacctgctgcccggcagaagaagaaccgtggacgccgccgccagcagaggccagggccccgagcccgcccccggcggcggcgtggagggcgtgggcgccagaggcgtggccctgaagctgttcgtgcagctgctgggctgcagcagattcggcggcgccgtggtgagagccggcgaggccgagcccagcggcgccgccagaagcgccagcagcggcagagaggagccccagcccgaggagggcgaggaggaggaggagaaggaggaggagagaggcccccagtggagactgggcgccagaaagcccggcagctggaccggcgaggccgccgtgtgcgccgacagcgcccccgccgccagagccccccaggccctggccagagccagcggcagaggcggcagagtggccagaagaggcgccgaggagagcggccccccccacagccccagcagaagaggcagcgccagcagagccggccccggcagagccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaacccctgcggcccctgcagcgagagaagaaagcacctgttcgtgcaggacccccagacctgcaagtgcagctgcaagaacaccgacagcagatgcaaggccagacagctggagctgaacgagagaacctgcagaagcctgaccagaaaggactag

SEQ ID NO: 2276 - DNA, 630 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaagaagagcgtgagaggcaagggcaagggccagaagagaaagagaaagaagagcagaccctgcggcccctgcagcgagagaagaaagcacctgttcgtgcaggacccccagacctgcaagtgcagctgcaagaacaccgacagcagatgcaaggccagacagctggagctgaacgagagaacctgcagatgcgacaagcccagaagatag

SEQ ID NO: 2277 - DNA, 576 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaacccctgcggcccctgcagcgagagaagaaagcacctgttcgtgcaggacccccagacctgcaagtgcagctgcaagaacaccgacagcagatgcaaggccagacagctggagctgaacgagagaacctgcagaagcctgaccagaaaggactag

SEQ ID NO: 2278 - DNA, 972 bp, Artificial Sequence
  Description of Artificial Sequence: Synthetic coding sequence
tgaagaggccagggccccgagcccgcccccggcggcggcgtggagggcgtgggcgccagaggcgtggccctgaagctgttcgtgcagctgctgggctgcagcagattcggcggcgccgtggtgagagccggcgaggccgagcccagcggcgccgccagaagcgccagcagcggcagagaggagccccagcccgaggagggcgaggaggaggaggagaaggaggaggagagaggcccccagtggagactgggcgccagaaagcccggcagctggaccggcgaggccgccgtgtgcgccgacagcgcccccgccgccagagccccccaggccctggccagagccagcggcagaggcggcagagtggccagaagaggcgccgaggagagcggccccccccacagccccagcagaagaggcagcgccagcagagccggccccggcagagccagcgagaccatgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaagaagagcgtgagaggcaagggcaagggccagaagagaaagagaaagaagagcagatacaagagctggagcgtgtgcgacaagcccagaagatag

SEQ ID NO: 2279 - DNA, 648 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaagaagagcgtgagaggcaagggcaagggccagaagagaaagagaaagaagagcagatacaagagctggagcgtgccctgcggcccctgcagcgagagaagaaagcacctgttcgtgcaggacccccagacctgcaagtgcagctgcaagaacaccgacagcagatgcaaggccagacagctggagctgaacgagagaacctgcagatgcgacaagcccagaagatag

SEQ ID NO: 2280 - DNA, 525 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaacccctgcggcccctgcagcgagagaagaaagcacctgttcgtgcaggacccccagacctgcaagtgcagctgcaagaacaccgacagcagatgcaagatgtag

SEQ ID NO: 2281 - DNA, 699 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaagaagagcgtgagaggcaagggcaagggccagaagagaaagagaaagaagagcagatacaagagctggagcgtgtacgtgggcgccagatgctgcctgatgccctggagcctgcccggcccccacccctgcggcccctgcagcgagagaagaaagcacctgttcgtgcaggacccccagacctgcaagtgcagctgcaagaacaccgacagcagatgcaaggccagacagctggagctgaacgagagaacctgcagatgcgacaagcccagaagatag

SEQ ID NO: 2282 - DNA, 576 bp, Artificial Sequence
  Description of Artificial Sequence: Synthetic coding sequence
atgaacttcctgctgagctgggtgcactggagcctggccctgctgctgtacctgcaccacgccaagtggagccaggccgcccccatggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaacccctgcggcccctgcagcgagagaagaaagcacctgttcgtgcaggacccccagacctgcaagtgcagctgcaagaacaccgacagcagatgcaaggccagacagctggagctgaacgagagaacctgcagatgcgacaagcccagaagatag

SEQ ID NO: 2283 - DNA, 1263 bp, Artificial Sequence
  Description of Artificial Sequence: Synthetic coding sequence
atgcacctgctgggcttcttcagcgtggcctgcagcctgctggccgccgccctgctgcccggccccagagaggcccccgccgccgccgccgccttcgagagcggcctggacctgagcgacgccgagcccgacgccggcgaggccaccgcctacgccagcaaggacctggaggagcagctgagaagcgtgagcagcgtggacgagctgatgaccgtgctgtaccccgagtactggaagatgtacaagtgccagctgagaaagggcggctggcagcacaacagagagcaggccaacctgaacagcagaaccgaggagaccatcaagttcgccgccgcccactacaacaccgagatcctgaagagcatcgacaacgagtggagaaagacccagtgcatgcccagagaggtgtgcatcgacgtgggcaaggagttcggcgtggccaccaacaccttcttcaagcccccctgcgtgagcgtgtacagatgcggcggctgctgcaacagcgagggcctgcagtgcatgaacaccagcaccagctacctgagcaagaccctgttcgagatcaccgtgcccctgagccagggccccaagcccgtgaccatcagcttcgccaaccacaccagctgcagatgcatgagcaagctggacgtgtacagacaggtgcacagcatcatcagaagaagcctgcccgccaccctgccccagtgccaggccgccaacaagacctgccccaccaactacatgtggaacaaccacatctgcagatgcctggcccaggaggacttcatgttcagcagcgacgccggcgacgacagcaccgacggcttccacgacatctgcggccccaacaaggagctggacgaggagacctgccagtgcgtgtgcagagccggcctgagacccgccagctgcggcccccacaaggagctggacagaaacagctgccagtgcgtgtgcaagaacaagctgttccccagccagtgcggcgccaacagagagttcgacgagaacacctgccagtgcgtgtgcaagagaacctgccccagaaaccagcccctgaaccccggcaagtgcgcctgcgagtgcaccgagagcccccagaagtgcctgctgaagggcaagaagttccaccaccagacctgcagctgctacagaagaccctgcaccaacagacagaaggcctgcgagcccggcttcagctacagcgaggaggtgtgcagatgcgtgcccagctactggaagagaccccagatgatgagctag

SEQ ID NO: 2284 - DNA, 510 bp, Artificial Sequence
  Description of Artificial Sequence: Synthetic coding sequence
atggacaccagaaacaaggcccagctgctggtgctgctgaccctgctgagcgtgctgttcagccagaccagcgcctggcccctgtacagagcccccagcgccctgagactgggcgacagaatccccttcgagggcgccaacgagcccgaccaggtgagcctgaaggaggacatcgacatgctgcagaacgccctggccgagaacgacaccccctactacgacgtgagcagaaacgccagacacgccgacggcgtgttcaccagcgacttcagcaagctgctgggccagctgagcgccaagaagtacctggagagcctgatgggcaagagagtgagcaacatcagcgaggaccccgtgcccgtgaagagacacagcgacgccgtgttcaccgacaactacaccagactgagaaagcagatggccgtgaagaagtacctgaacagcatcctgaacggcaagagaagcagcgagggcgagagccccgacttccccgaggagctggagaagtag

SEQ ID NO: 2285 - DNA, 513 bp, Artificial Sequence
  Description of Artificial Sequence: Synthetic coding sequence
atggacaccagaaacaaggcccagctgctggtgctgctgaccctgctgagcgtgctgttcagccagaccagcgcctggcccctgtacagagcccccagcgccctgagactgggcgacagaatccccttcgagggcgccaacgagcccgaccaggtgagcctgaaggaggacatcgacatgctgcagaacgccctggccgagaacgacaccccctactacgacgtgagcagaaacgccagacacgccgacggcgtgttcaccagcgacttcagcaagctgctgggccagctgagcgccaagaagtacctggagagcctgatgggcaagagagtgagcagcaacatcagcgaggaccccgtgcccgtgaagagacacagcgacgccgtgttcaccgacaactacaccagactgagaaagcagatggccgtgaagaagtacctgaacagcatcctgaacggcaagagaagcagcgagggcgagagccccgacttccccgaggagctggagaagtag

SEQ ID NO: 2286 - DNA, 360 bp, Artificial Sequence
  Description of Artificial Sequence: Synthetic coding sequence
tgagtgagcctgaaggaggacatcgacatgctgcagaacgccctggccgagaacgacaccccctactacgacgtgagcagaaacgccagacacgccgacggcgtgttcaccagcgacttcagcaagctgctgggccagctgagcgccaagaagtacctggagagcctgatgggcaagagagtgagcagcaacatcagcgaggaccccgtgcccgtgaagagacacagcgacgccgtgttcaccgacaactacaccagactgagaaagcagatggccgtgaagaagtacctgaacagcatcctgaacggcaagagaagcgagggcgagagccccgacttccccgaggagctggagaagtag

SEQ ID NO: 2287 - DNA, 774 bp, Artificial Sequence
  Description of Artificial Sequence: Synthetic coding sequence
atgcccctgaacgtgagcttcaccaacagaaactacgacctggactacgacagcgtgcagccctacttctactgcgacgaggaggagaacttctaccagcagcagcagcagagcgagctgcagccccccgcccccagcgaggacatctggaagaagttcgagctgctgcccaccccccccctgagccccagcagaagaagcggcctgtgcagccccagctacgtggccgtgacccccttcagcctgagaggcgacaacgacggcggcggcggcagcttcagcaccgccgaccagctggagatggtgaccgagctgctgggcggcgacatggtgaaccagagcttcatctgcgaccccgacgacgagaccttcatcaagaacatcatcatccaggactgcatgtggagcggcttcagcgccgccgccaagctggtgagcgagaagctggccagctaccaggccgccagaaaggacagcggcagccccaaccccgccagaggccacagcgtgtgcagcaccagcagcctgtacctgcaggacctgagcgccgccgccagcgagtgcatcgaccccagcgtggtgttcccctaccccctgaacgacagcagcagccccaagagctgcgccagccaggacagcagcgccttcagccccagcagcgacagcctgctgagcagcaccgagagcagcccccagggcagccccgagcccctggtgctgcacgaggagaccccccccaccaccagcagcgacagcggcggcaccagaagatag

SEQ ID NO: 2288 - DNA, 1365 bp, Artificial Sequence
  Description of Artificial Sequence: Synthetic coding sequence
ctggacttcttcagagtggtggagaaccagcagccccccgccaccatgcccctgaacgtgagcttcaccaacagaaactacgacctggactacgacagcgtgcagccctacttctactgcgacgaggaggagaacttctaccagcagcagcagcagagcgagctgcagccccccgcccccagcgaggacatctggaagaagttcgagctgctgcccaccccccccctgagccccagcagaagaagcggcctgtgcagccccagctacgtggccgtgacccccttcagcctgagaggcgacaacgacggcggcggcggcagcttcagcaccgccgaccagctggagatggtgaccgagctgctgggcggcgacatggtgaaccagagcttcatctgcgaccccgacgacgagaccttcatcaagaacatcatcatccaggactgcatgtggagcggcttcagcgccgccgccaagctggtgagcgagaagctggccagctaccaggccgccagaaaggacagcggcagccccaaccccgccagaggccacagcgtgtgcagcaccagcagcctgtacctgcaggacctgagcgccgccgccagcgagtgcatcgaccccagcgtggtgttcccctaccccctgaacgacagcagcagccccaagagctgcgccagccaggacagcagcgccttcagccccagcagcgacagcctgctgagcagcaccgagagcagcccccagggcagccccgagcccctggtgctgcacgaggagaccccccccaccaccagcagcgacagcgaggaggagcaggaggacgaggaggagatcgacgtggtgagcgtggagaagagacaggcccccggcaagagaagcgagagcggcagccccagcgccggcggccacagcaagcccccccacagccccctggtgctgaagagatgccacgtgagcacccaccagcacaactacgccgccccccccagcaccagaaaggactaccccgccgccaagagagtgaagctggacagcgtgagagtgctgagacagatcagcaacaacagaaagtgcaccagccccagaagcagcgacaccgaggagaacgtgaagagaagaacccacaacgtgctggagagacagagaagaaacgagctgaagagaagcttcttcgccctgagagaccagatccccgagctggagaacaacgagaaggcccccaaggtggtgatcctgaagaaggccaccgcctacatcctgagcgtgcaggccgaggagcagaagctgatcagcgaggaggacctgctgagaaagagaagagagcagctgaagcacaagctggagcagctgagaaacagctgcgcctag

SEQ ID NO: 2289 - DNA, 1263 bp, Artificial Sequence
  Description of Artificial Sequence: Synthetic coding sequence
atgcccctgaacgtgagcttcaccaacagaaactacgacctggactacgacagcgtgcagccctacttctactgcgacgaggaggacatctggaagaagttcgagctgctgcccaccccccccctgagccccagcagaagaagcggcctgtgcagccccagctacgtggccgtgacccccttcagcctgagaggcgacaacgacggcggcggcggcagcttcagcaccgccgaccagctggagatggtgaccgagctgctgggcggcgacatggtgaaccagagcttcatctgcgaccccgacgacgagaccttcatcaagaacatcatcatccaggactgcatgtggagcggcttcagcgccgccgccaagctggtgagcgagaagctggccagctaccaggccgccagaaaggacagcggcagccccaaccccgccagaggccacagcgtgtgcagcaccagcagcctgtacctgcaggacctgagcgccgccgccagcgagtgcatcgaccccagcgtggtgttcccctaccccctgaacgacagcagcagccccaagagctgcgccagccaggacagcagcgccttcagccccagcagcgacagcctgctgagcagcaccgagagcagcccccagggcagccccgagcccctggtgctgcacgaggagaccccccccaccaccagcagcgacagcgaggaggagcaggaggacgaggaggagatcgacgtggtgagcgtggagaagagacaggcccccggcaagagaagcgagagcggcagccccagcgccggcggccacagcaagcccccccacagccccctggtgctgaagagatgccacgtgagcacccaccagcacaactacgccgccccccccagcaccagaaaggactaccccgccgccaagagagtgaagctggacagcgtgagagtgctgagacagatcagcaacaacagaaagtgcaccagccccagaagcagcgacaccgaggagaacgtgaagagaagaacccacaacgtgctggagagacagagaagaaacgagctgaagagaagcttcttcgccctgagagaccagatccccgagctggagaacaacgagaaggcccccaaggtggtgatcctgaagaaggccaccgcctacatcctgagcgtgcaggccgaggagcagaagctgatcagcgaggaggacctgctgagaaagagaagagagcagctgaagcacaagctggagcagctgagaaacagctgcgcctag

SEQ ID NO: 2290 - DNA, 1362 bp, Artificial Sequence
  Description of Artificial Sequence: Synthetic coding sequence
ctggacttcttcagagtggtggagaaccagccccccgccaccatgcccctgaacgtgagcttcaccaacagaaactacgacctggactacgacagcgtgcagccctacttctactgcgacgaggaggagaacttctaccagcagcagcagcagagcgagctgcagccccccgcccccagcgaggacatctggaagaagttcgagctgctgcccaccccccccctgagccccagcagaagaagcggcctgtgcagccccagctacgtggccgtgacccccttcagcctgagaggcgacaacgacggcggcggcggcagcttcagcaccgccgaccagctggagatggtgaccgagctgctgggcggcgacatggtgaaccagagcttcatctgcgaccccgacgacgagaccttcatcaagaacatcatcatccaggactgcatgtggagcggcttcagcgccgccgccaagctggtgagcgagaagctggccagctaccaggccgccagaaaggacagcggcagccccaaccccgccagaggccacagcgtgtgcagcaccagcagcctgtacctgcaggacctgagcgccgccgccagcgagtgcatcgaccccagcgtggtgttcccctaccccctgaacgacagcagcagccccaagagctgcgccagccaggacagcagcgccttcagccccagcagcgacagcctgctgagcagcaccgagagcagcccccagggcagccccgagcccctggtgctgcacgaggagaccccccccaccaccagcagcgacagcgaggaggagcaggaggacgaggaggagatcgacgtggtgagcgtggagaagagacaggcccccggcaagagaagcgagagcggcagccccagcgccggcggccacagcaagcccccccacagccccctggtgctgaagagatgccacgtgagcacccaccagcacaactacgccgccccccccagcaccagaaaggactaccccgccgccaagagagtgaagctggacagcgtgagagtgctgagacagatcagcaacaacagaaagtgcaccagccccagaagcagcgacaccgaggagaacgtgaagagaagaacccacaacgtgctggagagacagagaagaaacgagctgaagagaagcttcttcgccctgagagaccagatccccgagctggagaacaacgagaaggcccccaaggtggtgatcctgaagaaggccaccgcctacatcctgagcgtgcaggccgaggagcagaagctgatcagcgaggaggacctgctgagaaagagaagagagcagctgaagcacaagctggagcagctgagaaacagctgcgcctag

SEQ ID NO: 2291 - DNA, 8442 bp, Artificial Sequence
  Description of Artificial Sequence: Synthetic coding sequence
atgatccccgccagattcgccggcgtgctgctggccctggccctgatcctgcccggcaccctgtgcgccgagggcaccagaggcagaagcagcaccgccagatgcagcctgttcggcagcgacttcgtgaacaccttcgacggcagcatgtacagcttcgccggctactgcagctacctgctggccggcggctgccagaagagaagcttcagcatcatcggcgacttccagaacggcaagagagtgagcctgagcgtgtacctgggcgagttcttcgacatccacctgttcgtgaacggcaccgtgacccagggcgaccagagagtgagcatgccctacgccagcaagggcctgtacctggagaccgaggccggctactacaagctgagcggcgaggcctacggcttcgtggccagaatcgacggcagcggcaacttccaggtgctgctgagcgacagatacttcaacaagacctgcggcctgtgcggcaacttcaacatcttcgccgaggacgacttcatgacccaggagggcaccctgaccagcgacccctacgacttcgccaacagctgggccctgagcagcggcgagcagtggtgcgagagagccagcccccccagcagcagctgcaacatcagcagcggcgagatgcagaagggcctgtgggagcagtgccagctgctgaagagcaccagcgtgttcgccagatgccaccccctggtggaccccgagcccttcgtggccctgtgcgagaagaccctgtgcgagtgcgccggcggcctggagtgcgcctgccccgccctgctggagtacgccagaacctgcgcccaggagggcatggtgctgtacggctggaccgaccacagcgcctgcagccccgtgtgccccgccggcatggagtacagacagtgcgtgagcccctgcgccagaacctgccagagcctgcacatcaacgagatgtgccaggagagatgcgtggacggctgcagctgccccgagggccagctgctggacgagggcctgtgcgtggagagcaccgagtgcccctgcgtgcacagcggcaagagatacccccccggcaccagcctgagcagagactgcaacacctgcatctgcagaaacagccagtggatctgcagcaacgaggagtgccccggcgagtgcctggtgaccggccagagccacttcaagagcttcgacaacagatacttcaccttcagcggcatctgccagtacctgctggccagagactgccaggaccacagcttcagcatcgtgatcgagaccgtgcagtgcgccgacgacagagacgccgtgtgcaccagaagcgtgaccgtgagactgcccggcctgcacaacagcctggtgaagctgaagcacggcgccggcgtggccatggacggccaggacgtgcagctgcccctgctgaagggcgacctgagaatccagcacaccgtgaccgccagcgtgagactgagctacggcgaggacctgcagatggactgggacggcagaggcagactgctggtgaagctgagccccgtgtacgccggcaagacctgcggcctgtgcggcaactacaacggcaaccagggcgacgacttcctgacccccagcggcctggccgagcccagagtggaggacttcggcaacgcctggaagctgcacggcgactgccaggacctgcagaagcagcacagcgacccctgcgccctgaaccccagaatgaccagattcagcgaggaggcctgcgccgtgctgaccagccccaccttcgaggcctgccacagagccgtgagccccctgccctacctgagaaactgcagatacgacgtgtgcagctgcagcgacggcagagagtgcctgtgcggcgccctggccagctacgccgccgcctgcgccggcagaggcgtgagagtggcctggagagagcccggcagatgcgagctgaactgccccaagggccaggtgtacctgcagtgcggcaccccctgcaacctgacctgcagaagcctgagctaccccgacgaggagtgcaacgaggcctgcctggagggctgcttctgcccccccggcctgtacatggacgagagaggcgactgcgtgcccaaggcccagtgcccctgctactacgacggcgagatcttccagcccgaggacatcttcagcgaccaccacaccatgtgctactgcgaggacggcttcatgcactgcaccatgagcggcgtgcccggcagcctgctgcccgacgccgtgctgagcagccccctgagccacagaagcaagagaagcctgagctgcagaccccccatggtgaagctggtgtgccccgccgacaacctgagagccgagggcctggagtgcaccaagacctgccagaactacgacctggagtgcatgagcatgggctgcgtgagcggctgcctgtgcccccccggcatggtgagacacgagaacagatgcgtggccctggagagatgcccctgcttccaccagggcaaggagtacgcccccggcgagaccgtgaagatcggctgcaacacctgcgtgtgccaggacagaaagtggaactgcaccgaccacgtgtgcgacgccacctgcagcaccatcggcatggcccactacctgaccttcgacggcctgaagtacctgttccccggcgagtgccagtacgtgctggtgcaggactactgcggcagcaaccccggcaccttcagaatcctggtgggcaacaagggctgcagccaccccagcgtgaagtgcaagaagagagtgaccatcctggtggagggcggcgagatcgagctgttcgacggcgaggtgaacgtgaagagacccatgaaggacgagacccacttcgaggtggtggagagcggcagatacatcatcctgctgctgggcaaggccctgagcgtggtgtgggacagacacctgagcatcagcgtggtgctgaagcagacctaccaggagaaggtgtgcggcctgtgcggcaacttcgacggcatccagaacaacgacctgaccagcagcaacctgcaggtggaggaggaccccgtggacttcggcaacagctggaaggtgagcagccagtgcgccgacaccagaaaggtgcccctggacagcagccccgccacctgccacaacaacatcatgaagcagaccatggtggacagcagctgcagaatcctgaccagcgacgtgttccaggactgcaacaagctggtggaccccgagccctacctggacgtgtgcatctacgacacctgcagctgcgagagcatcggcgactgcgcctgcttctgcgacaccatcgccgcctacgcccacgtgtgcgcccagcacggcaaggtggtgacctggagaaccgccaccctgtgcccccagagctgcgaggagagaaacctgagagagaacggctacgagtgcgagtggagatacaacagctgcgcccccgcctgccaggtgacctgccagcaccccgagcccctggcctgccccgtgcagtgcgtggagggctgccacgcccactgcccccccggcaagatcctggacgagctgctgcagacctgcgtggaccccgaggactgccccgtgtgcgaggtggccggcagaagattcgccagcggcaagaaggtgaccctgaaccccagcgaccccgagcactgccagatctgccactgcgacgtggtgaacctgacctgcgaggcctgccaggagcccggcggcctggtggtgccccccaccgacgcccccgtgagccccaccaccctgtacgtggaggacatcagcgagccccccctgcacgacttctactgcagcagactgctggacctggtgttcctgctggacggcagcagcagactgagcgaggccgagttcgaggtgctgaaggccttcgtggtggacatgatggagagactgagaatcagccagaagtgggtgagagtggccgtggtggagtaccacgacggcagccacgcctacatcggcctgaaggacagaaagagacccagcgagctgagaagaatcgccagccaggtgaagtacgccggcagccaggtggccagcaccagcgaggtgctgaagtacaccctgttccagatcttcagcaagatcgacagacccgaggccagcagaatcaccctgctgctgatggccagccaggagccccagagaatgagcagaaacttcgtgagatacgtgcagggcctgaagaagaagaaggtgatcgtgatccccgtgggcatcggcccccacgccaacctgaagcagatcagactgatcgagaagcaggcccccgagaacaaggccttcgtgctgagcagcgtggacgagctggagcagcagagagacgagatcgtgagctacctgtgcgacctggcccccgaggcccccccccccaccctgccccccgacatggcccaggtgaccgtgggccccggcctgctgggcgtgagcaccctgggccccaagagaaacagcatggtgctggacgtggccttcgtgctggagggcagcgacaagatcggcgaggccgacttcaacagaagcaaggagttcatggaggaggtgatccagagaatggacgtgggccaggacagcatccacgtgaccgtgctgcagtacagctacatggtgaccgtggagtaccccttcagcgaggcccagagcaagggcgacatcctgcagagagtgagagagatcagataccagggcggcaacagaaccaacaccggcctggccctgagatacctgagcgaccacagcttcctggtgagccagggcgacagagagcaggcccccaacctggtgtacatggtgaccggcaaccccgccagcgacgagatcaagagactgcccggcgacatccaggtggtgcccatcggcgtgggccccaacgccaacgtgcaggagctggagagaatcggctggcccaacgcccccatcctgatccaggacttcgagaccctgcccagagaggcccccgacctggtgctgcagagatgctgcagcggcgagggcctgcagatccccaccctgagccccgcccccgactgcagccagcccctggacgtgatcctgctgctggacggcagcagcagcttccccgccagctacttcgacgagatgaagagcttcgccaaggccttcatcagcaaggccaacatcggccccagactgacccaggtgagcgtgctgcagtacggcagcatcaccaccatcgacgtgccctggaacgtggtgcccgagaaggcccacctgctgagcctggtggacgtgatgcagagagagggcggccccagccagatcggcgacgccctgggcttcgccgtgagatacctgaccagcgagatgcacggcgccagacccggcgccagcaaggccgtggtgatcctggtgaccgacgtgagcgtggacagcgtggacgccgccgccgacgccgccagaagcaacagagtgaccgtgttccccatcggcatcggcgacagatacgacgccgcccagctgagaatcctggccggccccgccggcgacagcaacgtggtgaagctgcagagaatcgaggacctgcccaccatggtgaccctgggcaacagcttcctgcacaagctgtgcagcggcttcgtgagaatctgcatggacgaggacggcaacgagaagagacccggcgacgtgtggaccctgcccgaccagtgccacaccgtgacctgccagcccgacggccagaccctgctgaagagccacagagtgaactgcgacagaggcctgagacccagctgccccaacagccagagccccgtgaaggtggaggagacctgcggctgcagatggacctgcccctgcgtgtgcaccggcagcagcaccagacacatcgtgaccttcgacggccagaacttcaagctgaccggcagctgcagctacgtgctgttccagaacaaggagcaggacctggaggtgatcctgcacaacggcgcctgcagccccggcgccagacagggctgcatgaagagcatcgaggtgaagcacagcgccctgagcgtggagctgcacagcgacatggaggtgaccgtgaacggcagactggtgagcgtgccctacgtgggcggcaacatggaggtgaacgtgtacggcgccatcatgcacgaggtgagattcaaccacctgggccacatcttcaccttcaccccccagaacaacgagttccagctgcagctgagccccaagaccttcgccagcaagacctacggcctgtgcggcatctgcgacgagaacggcgccaacgacttcatgctgagagacggcaccgtgaccaccgactggaagaccctggtgcaggagtggaccgtgcagagacccggccagacctgccagcccatcctggaggagcagtgcctggtgcccgacagcagccactgccaggtgctgctgctgcccctgttcgccgagtgccacaaggtgctggcccccgccaccttctacgccatctgccagcaggacagctgccaccaggagcaggtgtgcgaggtgatcgccagctacgcccacctgtgcagaaccaacggcgtgtgcgtggactggagaacccccgacttctgcgccatgagctgcccccccagcctggtgtacaaccactgcgagcacggctgccccagacactgcgacggcaacgtgagcagctgcggcgaccaccccagcgagggctgcttctgcccccccgacaaggtgatgctggagggcagctgcgtgcccgaggaggcctgcacccagtgcatcggcgaggacggcgtgcagcaccagttcctggaggcctgggtgcccgaccaccagccctgccagatctgcacctgcctgagcggcagaaaggtgaactgcaccacccagccctgccccaccgccaaggcccccacctgcggcctgtgcgaggtggccagactgagacagaacgccgaccagtgctgccccgagtacgagtgcgtgtgcgaccccgtgagctgcgacctgccccccgtgccccactgcgagagaggcctgcagcccaccctgaccaaccccggcgagtgcagacccaacttcacctgcgcctgcagaaaggaggagtgcaagagagtgagcccccccagctgccccccccacagactgcccaccctgagaaagacccagtgctgcgacgagtacgagtgcgcctgcaactgcgtgaacagcaccgtgagctgccccctgggctacctggccagcaccgccaccaacgactgcggctgcaccaccaccacctgcctgcccgacaaggtgtgcgtgcacagaagcaccatctaccccgtgggccagttctgggaggagggctgcgacgtgtgcacctgcaccgacatggaggacgccgtgatgggcctgagagtggcccagtgcagccagaagccctgcgaggacagctgcagaagcggcttcacctacgtgctgcacgagggcgagtgctgcggcagatgcctgcccagcgcctgcgaggtggtgaccggcagccccagaggcgacagccagagcagctggaagagcgtgggcagccagtgggccagccccgagaacccctgcctgatcaacgagtgcgtgagagtgaaggaggaggtgttcatccagcagagaaacgtgagctgcccccagctggaggtgcccgtgtgccccagcggcttccagctgagctgcaagaccagcgcctgctgccccagctgcagatgcgagagaatggaggcctgcatgctgaacggcaccgtgatcggccccggcaagaccgtgatgatcgacgtgtgcaccacctgcagatgcatggtgcaggtgggcgtgatcagcggcttcaagctggagtgcagaaagaccacctgcaacccctgccccctgggctacaaggaggagaacaacaccggcgagtgctgcggcagatgcctgcccaccgcctgcaccatccagctgagaggcggccagatcatgaccctgaagagagacgagaccctgcaggacggctgcgacacccacttctgcaaggtgaacgagagaggcgagtacttctgggagaagagagtgaccggctgcccccccttcgacgagcacaagtgcctggccgagggcggcaagatcatgaagatccccggcacctgctgcgacacctgcgaggagcccgagtgcaacgacatcaccgccagactgcagtacgtgaaggtgggcagctgcaagagcgaggtggaggtggacatccactactgccagggcaagtgcgccagcaaggccatgtacagcatcgacatcaacgacgtgcaggaccagtgcagctgctgcagccccaccagaaccgagcccatgcaggtggccctgcactgcaccaacggcagcgtggtgtaccacgaggtgctgaacgccatggagtgcaagtgcagccccagaaagtgcagcaagtag

SEQ ID NO: 2292 - DNA, 816 bp, Artificial Sequence
  Description of Artificial Sequence: Synthetic coding sequence
atgaccgagccccaggtgggctgcgtggcctgccccagagtgcacaaggagcccgcccaggtgggcaccccctggcccgccaagcccagaagccaccccagaaagagagaccccaccgccctgctgcccagaagcctgtggcccgcctgccaggagagcgtgaccgccctgtgcttcctgcaggagaccgtggagagactgggccagagccccgcccaggacacccccgtgctgggcccctgctgggaccccatggccctgggcacccagggcagactgctgctggacagagacagcaaggacacccagaccagaatcagccagaagggcagaagactgcagccccccggcacccccagcgcccccccccagagaagacccagaaagcagctgaacccctgcagaggcaccgagagagtggaccccggcttcgagggcgtgaccctgaagttccagatcaagcccgacagcagcctgcagatcatccccacctacagcctgccctgcagcagcagaagccaggagagccccgccgacgccgtgggcggccccgccgcccaccccggcggcaccgaggcccacagcgccggcagcgaggccctggagcccagaagatgcgccagctgcagaacccagagaacccccctgtggagagacgccgaggacggcacccccctgtgcaacgcctgcggcatcagatacaagaagtacggcaccagatgcagcagctgctggctggtgcccagaaagaacgtgcagcccaagagactgtgcggcagatgcggcgtgagcctggaccccatccaggagggctag

SEQ ID NO: 2293 - DNA, 1182 bp, Artificial Sequence
  Description of Artificial Sequence: Synthetic coding sequence
atgacgacctacagcgacaaaggagctaagccggagcggggcagatttctccacttccattcagtgacattttgggtgggcaatgccaaacaggcaacatccttctactgctcaaagatgggtttcgagcccttggcatacagagggctggagacagggtcgcgggaggtggtgtcccacgtcatcaagcagggcaagatcgtgttcgtgctttcatcggctttaaatccatggaacaaggagatgggtgaccacctagtcaagcatggtgacggtgtcaaggacatcgccttcgaggtggaagattgtgactacattgtccaaaaagcccgcgagagaggcgctaagattatgagagagccttgggtcgagcaggacaagttcggcaaagtgaagttcgcagtccttcagacctacggcgataccactcacaccctagtggaaaaaatgaattatattggtcagtttttgccaggatacgaagccccagctttcatggatccactcctccccaaactgcccaaatgcagcctcgagatgatcgatcacattgtgggcaaccaaccagatcaggaaatggtgagcgcctccgaatggtacctcaaaaacttgcagttccatcgtttttggtcggttgatgatacccaggttcacaccgaatattcctccctgcgatcgatcgtggtagccaactatgaagaatccattaagatgccaatcaacgagcctgctcctgggaagaaaaaaagccaaattcaggagtacgtggactacaatgggggtgcgggcgtacagcacatcgccctgaaaaccgaagacattatcacagctataaggcacctccgggaaaggggcctcgaatttctctcagtgccaagcacctactacaaacagctccgcgaaaagctcaagacagccaagattaaagtgaaagagaatatcgatgctctggaagagctgaagattctcgtggattatgatgagaaggggtatctcttgcagatttttacgaagcccgtccaggaccgacccactctgttcttggaggttattcaacggcataaccaccagggttttggcgcaggcaacttcaactccctgttcaaagccttcgaagaggaacagaatcttcgagggaatctaacgaatatggagacaaatggagttgttcctggcatgtag

SEQ ID NO: 2294 - DNA, 1065 bp, Artificial Sequence
  Description of Artificial Sequence: Synthetic coding sequence
atgggcttcgaaccactggcttatcgggggctggagactggctccagagaggtcgtctcacacgtgatcaaacagggtaagatcgtatttgtgctttctagcgcactcaacccgtggaataaggagatgggtgatcatttggtcaagcacggagatggagtgaaggatattgccttcgaggttgaggattgcgactacatcgtacagaaagccagagaaaggggcgcaaagattatgcgcgagccttgggtggagcaagacaaatttggtaaggttaaattcgccgtgctgcagacttacggagatacaacgcacaccttggtggagaagatgaattacattggtcagtttctccctggatatgaagctccagcattcatggatcctcttctcccaaaactccccaaatgttctttggagatgattgatcacatagtgggcaatcagcccgaccaggagatggtgtccgcgtccgaatggtacctgaagaatctgcagtttcatcggttttggagtgtggacgacacccaggtgcataccgagtactcttctctgagatctattgttgtagctaactacgaggaatccattaagatgcccatcaacgagccagcccccggaaagaaaaagtctcaaatccaagaatacgttgactacaatgggggggcaggcgtgcaacacatcgcccttaaaactgaggatatcattacggcgatccggcatcttagggagagagggctagaatttctcagcgtgccaagcacatactataagcagctcagggaaaaactgaaaactgccaagatcaaagtcaaagaaaacatcgatgctttggaggagctcaaaatactggtcgactacgatgaaaaagggtatctgctccagatatttactaaacctgtgcaggatcggcctaccctctttttggaggttattcaacgtcacaaccatcaaggctttggagccgggaattttaactccctgtttaaagcctttgaggaagagcaaaacctcagaggcaacttaaccaacatggaaacaaatggcgtggtgcccggaatgtag

SEQ ID NO: 2295 - DNA, 1173 bp, Artificial Sequence
  Description of Artificial Sequence: Synthetic coding sequence
tacagtgacaaaggcgcaaaacctgaacgtggccgcttcctgcattttcattctgttaccttctgggtcggaaacgccaagcaggcaacaagcttttattgtagtaagatggggtttgagcccttagcctaccgggggctggagacagggtctagggaggtagtgtcccatgtgatcaaacaaggaaaaatcgtcttcgtgctgagttcggcactcaacccatggaacaaggagatgggtgaccaccttgtaaaacatggcgacggagtaaaggacatcgcctttgaggtcgaggactgtgactatatagtacagaaggcccgagagagaggggctaagataatgcgagaaccctgggtcgagcaggataaattcggtaaggtgaaatttgccgtcctgcagacatatggagacactactcacaccttagttgaaaaaatgaattatattggccagttcctgcccggttacgaagcccccgcctttatggatccacttttacctaaactgcccaaatgttctctggaaatgattgatcatatcgtgggcaatcagccagaccaagaaatggtgagcgcctcagaatggtacttgaagaatttgcaattccatcgcttctggtcagtggacgacacccaagtacatacagagtatagtagtctgcggtccatagtggttgccaattacgaggaatcaatcaagatgccaatcaacgagcctgccccaggcaagaagaaatcacaaatccaggagtatgtggattacaatggtggggcaggcgtgcaacacatcgccttaaagaccgaagatatcataacagccattcgccacctgcgggagaggggcctagaatttctttctgttccatctacttactataaacagttgagggaaaagctgaaaaccgcaaaaattaaagttaaagagaatatcgacgcccttgaagaactcaagatcctcgtggactatgatgagaaggggtacttactgcagatttttacgaaacccgtccaagacaggccaactctgttccttgaggtgattcagcgccacaaccaccagggatttggcgctggtaacttcaatagtctgtttaaggctttcgaggaggagcagaatttgcgcggaaatctcaccaatatggagaccaatggagtagtgccgggaatgtag

SEQ ID NO: 2296 - DNA, 438 bp, Artificial Sequence
  Description of Artificial Sequence: Synthetic coding sequence
atgtctactgaggggggcggtaggagatgtcaggcacaggtgtcccggaggatttctttcagcgcctcacacagactttacagcaaattcctgtcagacgaagagaatctcaagctgtttggaaagtgtaacaacccaaatggccatgggcacaactacaaggtggtagtcacggtccacggcgaaatcgatcccgccactgggatggtcatgaatttagccgatcttaagaaatacatggaggaggctattatgcaacccctggaccacaagaacttggacatggacgtgccatacttcgcagacgtggtctctaccacagaaaacgtcgcggtgtacatttgggacaacctccagaaggtcctgccggtgggcgttctgtacaaggtaaaggtgtatgagacagacaacaacatagtggtgtataaaggagagtag

SEQ ID NO: 2297 - DNA, 4284 bp, Artificial Sequence
  Description of Artificial Sequence: Synthetic coding sequence
atgcaccagcggcacccacgggcccgctgtccaccactgtgcgtcgcaggtatcctcgcatgcggattcctgttgggctgctgggggccctcacacttccagcaaagctgcctgcaggccctggagccacaggccgtaagctcatacctatctcccggagctccactcaaggggcgcccacccagcccaggctttcagcgacagagacaacggcagcggcgggccgctggagggatactccatctcgaactgctcgtggcggtgggacccgacgtcttccaggcccatcaagaggacaccgaacgctatgtcttaactaacttgaacataggagccgagctattgagagatccctccctgggagcacagtttcgcgttcatcttgtgaagatggtgattcttaccgagccagaaggcgcccccaatatcaccgccaatctgacatcctccctccttagtgtttgcggctggtcccaaacaatcaatcctgaagatgatacggaccctggccacgctgatttggtcctgtatattacgaggtttgatttggagctgcctgacgggaatcggcaggtcaggggcgtcacccaactcggtggcgcttgctctcctacctggagttgtttgattacagaggatacaggtttcgatctgggcgtcaccattgcacacgaaattgggcactcattcgggttagaacacgacggagcccccggcagcggctgcgggccctccggccatgttatggcctccgatggcgccgcaccccgcgctgggttagcttggagcccttgctctcgtaggcagttgctgtcactgctgtccgctggcagagcacgttgcgtgtgggaccctcctcggccccagccggggtcagcaggacaccctcccgacgcccagccaggactatactattccgccaacgagcaatgtagagtagcattcggccccaaagccgtcgcctgcacatttgccagggaacaccttgacatgtgccaggccctttcgtgccacaccgaccctctggaccagtcttcatgctccaggctgcttgtgccccttctggacggaaccgagtgcggagtcgagaaatggtgtagtaaaggtcggtgtagaagcctggtggaactaacacctatcgctgctgtacacgggagatggagctcttggggcccaagaagcccttgttcgagatcgtgtggcggtggagttgtgacccgtagacggcagtgtaacaaccctaggcccgcattcggagggagagcatgcgtgggggccgatttacaagcagaaatgtgtaatacccaggcatgcgaaaagacacagcttgaatttatgtctcagcagtgtgcaagaaccgatgggcagccgctgcggagtagcccaggaggagcgtcattttaccattggggagccgcagtcccccactcccagggtgatgccctgtgtcggcacatgtgtcgagctatcggcgaatcttttattatgaaacgtggtgactcatttctggacggcaccaggtgcatgccttcagggcctagagaggatgggactttatcgctatgcgtgtccgggtcctgccggaccttcggatgcgatgggagaatggactcgcagcaggtctgggatagatgccaggtgtgcggaggtgataacagcacttgttcaccgaggaagggttccttcaccgcaggccgtgcccgcgaatacgtgacatttctcaccgttacacccaacctgacatctgtgtacattgcaaaccacaggcccttgtttacacatctggcggtgagaattggaggtcgttacgtggtggcaggcaaaatgtctatatctcccaacacaacctacccttctctgctggaggatggtcgcgtcgagtatcgggtcgctctcactgaggacaggctgccacggctcgaggaaatccggatttgggggcctcttcaggaggatgccgatatccaagtctatagaagatacggcgaggagtacggcaatttaactaggccagatatcacattcacttactttcagccaaagccaaggcaggcttgggtgtgggcggccgtcagaggtccatgtagcgtgtcctgtggcgctggcctgaggtgggttaattactcatgtttggatcaggcccgaaaagagctggtggaaaccgtgcaatgtcagggatcacagcagccccccgcatggcccgaagcgtgtgtgctagagccctgccccccgtactgggccgtgggtgatttcggcccatgctctgcctcttgcgggggcggcctcagagagagacctgtacggtgcgtcgaggctcagggctccctgctgaagactttaccccccgctcgctgtagggccggggcacaacagcccgcagtggccctggaaacctgcaacccacaaccatgtcctgcccggtgggaggtgagtgagccaagcagctgcacttcagccggcggggcaggactggcgttggaaaatgagacctgtgtgcctggcgccgatgggttggaggcccctgtgacagagggccctgggtctgtggacgagaagctgcctgcccctgagccttgcgtcggaatgagctgtcctccaggctgggggcatctcgacgccacatccgctggagaaaaagctccctcaccatggggctcaattaggactggggcccaggccgcacacgtttggacccctgccgccggcagctgctccgtcagctgcggccgaggtctgatggagctacgctttctttgtatggattctgcacttcgcgtgccggtgcaggaggaactttgcggactggcttccaagcctggctcaaggcgcgaggtatgccaggcagtgccttgtcccgcaaggtggcagtataagctggctgcctgttctgtgtcttgtgggagaggagtggtcagaagaatcctgtattgcgcgagagcccatggggaagatgacggcgaggaaatactgctagacacacagtgccagggactgccccgacctgagcctcaagaagcctgctcgttagagccttgccccccgaggtggaaggtaatgagtctcggtccctgttcagcctcttgtggtctcgggactgcccggcgcagcgtggcctgtgtgcaactagatcagggccaagacgtggaagttgacgaagccgcttgtgctgcccttgttaggcccgaagcttcggttccatgtttaattgcagattgtacctacagatggcatgtaggcacctggatggagtgcagcgtgtcttgcggcgatggaattcagagacgccgggatacttgtctgggcccacaggcccaagcccctgtgcccgctgacttttgccagcacctgccgaaaccggtaaccgtgcgtgggtgctgggccggcccctgcgtcggacagggaacaccttccttagttccgcacgaggaagccgccgcccctggcagaactacagcaacccccgctggcgcctctctcgagtggtctcaggcacgcggcctgctgttctctcccgcgccacaaccccgcagattgctcccaggcccccaagagaattcagttcagagctccgcctgtgggaggcagcatcttgagcctaccggcacaattgatatgcggggcccagggcaagccgactgtgctgtagcgattgggcggcctttgggggaggtggtgaccctcagggtgctggagtctagcctgaactgttctgcaggcgacatgctcctgctctggggccggctgacctggcgcaagatgtgcagaaagcttctcgacatgaccttttcgtctaagacaaacacgttggtggtgagacaacgatgcggtcgaccaggcgggggtgtgctgttgagatatggaagccaacttgcacccgagactttttatagagagtgtgacatgcagttattcggcccatggggagagatcgtgtctccatctctgtcccccgcaacgtcaaacgctggcggttgccgtctgttcatcaatgtggcaccgcacgcaagaatagccatccacgcccttgcaaccaacatgggcgccggcactgagggcgcgaacgcatcatacatcctgatccgcgacactcacagcctgagaaccaccgctttccacggtcaacaggtgctctactgggaatcagagagttctcaggccgagatggaatttagcgaggggttccttaaagctcaggcttcactccgcggacagtattggacactgcagtcctgggtgcctgagatgcaggatccccagtcgtggaagggcaaagagggcacttag

SEQ ID NO: 2298 - DNA, 3309 bp, Artificial Sequence
  Description of Artificial Sequence: Synthetic coding sequence
atgtttcaactgcccgtcaataatctcggctcccttagaaaggccagaaaaaccgtcaagaagatcctttccgacatcggattggagtattgtaaggagcatattgaggacttcaaacagttcgaaccaaacgacttttatctgaagaacaccacatgggaggacgtcgggttgtgggacccctccttgacgaaaaaccaggactatcgcaccaagcctttctgctgctcagcttgcccattcagctccaagtttttctctgcctacaaatcgcattttcgcaatgtgcattctgaggactttgagaatcggatcctactcaattgtccctattgtacctttaatgctgacaaaaagactctggagactcacattaagatatttcacgctcccaacgctagtgccccgtcttctagtttgagcaccttcaaagataaaaacaaaaacgacggattaaagcccaagcaggcagactcggtagaacaggcagtgtattactgtaagaagtgtacgtatcgcgatcctctctatgaaatcgtccgtaaacatatttatagggaacattttcagcacgttgccgccccttacatcgccaaggctggggagaaaagcctgaatggggccgtccccctgggcagcaacgcaagagaggagagcagcatccactgcaagaggtgtctttttatgcccaagagctacgaggctcttgtgcagcacgtgatcgaagatcatgagaggatagggtatcaggtcactgcgatgatcggccatacgaacgtggtcgtgcccagaagcaagcctcttatgttgattgcacccaaacctcaagataaaaagagcatgggtttgcctcctaggataggatccctagcttcgggcaatgttcggagtctcccatcgcagcagatggtgaaccggctatctattcctaagccaaacctgaattccaccggggttaacatgatgtcctccgtgcatcttcagcagaacaactatggcgtaaaatccgtgggccagggatactctgtaggtcagtctatgcgactgggactgggagggaatgccccagtgtctatccctcaacagtcacaatcagtgaaacagctcctgccctcaggtaacggcagatcttacgggcttgggagcgaacagagatcacaggctccagcgaggtacagtctgcagtctgcaaatgcctcatcactctctagcggacagctcaagtccccgagcctgagccaatctcaggcttccagagtgctgggccagagttcctccaagcctgccgccgccgccactggcccccctccaggcaatacctcatcaacgcagaagtggaagatctgtactatttgtaatgagctgttcccagaaaacgtgtactcagtgcacttcgaaaaagagcacaaggccgaaaaggtccctgccgtggccaattacatcatgaagatacacaatttcacttctaaatgcctgtactgtaataggtatcttccaaccgataccctattgaaccacatgcttatccatgggttaagctgtccttactgccggagcacattcaacgatgttgagaagatggccgcgcatatgcgcatggttcacattgacgaggaaatgggacccaaaaccgatagtacattgtcttttgaccttactttgcagcagggctctcacaccaacatccacctactcgtgaccacttacaacctgagggatgccccagccgagtctgtcgcttaccatgctcaaaacaatcctcccgtgcctccaaagccacagcctaaggtacaggagaaagccgacattccggttaagtcaagccctcaagccgccgtaccctacaagaaagatgtaggaaaaaccctgtgccctctgtgcttcagcattctgaaagggccaatttccgatgctcttgcccatcacttgagagaacggcatcaggtgatccagactgttcaccctgtcgaaaagaagcttacctacaagtgcatccattgtctcggagtctacacgtcgaacatgacagcttctacaattactctccaccttgtccattgcaggggagtcggaaaaacccagaacggccaagacaaaaccaacgccccatctagactcaatcaatcgcctagcctggcgcccgttaagagaacttacgagcagatggagttccccctgttgaagaaaaggaaattagacgatgatagtgactctccgtcattctttgaggaaaaacctgaagagccggttgtgctcgctttagatcctaagggacatgaggatgacagctatgaggcccggaagagttttctgacaaagtattttaacaaacagccctatcctactcgtagggagattgagaaactcgcagcctccttgtggctctggaagtccgacatagcttcacatttctctaataagaggaagaaatgcgtgagggactgcgaaaaatacaagcccggtgttctgcttggattcaacatgaaagagctcaataaagtgaaacacgagatggactttgatgccgagtggctctttgaaaaccacgacgagaaggatagccgggtcaacgcttccaagaccgccgataaaaagctgaacctcgggaaggaggatgactcgtcttcagacagctttgaaaatctagaagaagaatctaatgagtctggcagccccttcgaccctgtgttcgaggtggagccaaagatttccaatgataacccagaggaacatgtgttaaaggtgatcccagaagacgcgagtgagtcagaggaaaagctggaccaaaaagaggacggctccaaatacgaaaccatccatctcaccgaagagccgaccaaactgatgcacaatgcatcagactctgaagtggatcaggatgatgttgtggagtggaaggatggcgcgagtccctcggagtctggccctgggtctcagcaggtctccgacttcgaagacaatacctgtgagatgaaacctggcacttggagcgacgagtcatctcaaagcgaggacgcacggtctagcaaacctgccgccaaaaaaaaggccacaatgcagggcgacagagagcagctgaaatggaagaactccagttacggcaaagtggagggcttctggtccaaggaccagtcacagtggaagaacgctagcgaaaacgatgaaagactgtccaacccgcagatagaatggcaaaattccacgatcgatagtgaggacggtgagcagtttgataatatgaccgatggcgtggctgagcccatgcatggctcactggctggtgtcaagctcagttcccagcaggcctag

SEQ ID NO: 2299 - DNA, 3309 bp, Artificial Sequence
  Description of Artificial Sequence: Synthetic coding sequence
atgtttcaactgcctgtgaataacctgggcagcctcaggaaggcccgcaaaaccgtgaaaaaaatcttaagtgatattggcctggagtattgtaaagaacacattgaagacttcaaacaattcgaacctaacgatttctacctgaagaacactacgtgggaagacgtcggcctttgggatccaagcctcacaaaaaaccaggattataggactaagcctttttgctgttccgcatgccctttctctagcaagttttttagcgcttacaagtcgcacttcaggaatgtgcactcggaagactttgaaaaccgtatcctgctgaattgtccatattgcacctttaacgccgacaaaaagaccctcgagactcacatcaagattttccatgcccccaacgccagcgcaccaagcagtagcctgtctactttcaaggacaagaataagaacgacgggctcaaacctaagcaagcagatagtgtcgaacaagctgtctactactgcaaaaaatgtacatatagggatcctctctatgagatcgtgaggaagcatatctaccgggagcattttcagcatgtcgcggctccgtatattgccaaagctggcgaaaagagcctgaacggtgccgtccctcttggatcaaatgcacgtgaagagagttcaattcactgtaagcggtgtctgtttatgcccaagtcctatgaagccttagtgcaacacgtcattgaggaccacgagcgcattggataccaggtcaccgctatgattgggcataccaatgtggtagtgccaaggagtaaacctctcatgctaatagcgcccaaaccacaggataaaaagtcaatgggcctaccccctcgcatcggaagtctggcttcaggcaatgtgcgttccctcccgtcccagcagatggtgaaccggctgagtatacctaagccaaatcttaattcgacaggggtgaacatgatgtctagcgtgcacctccaacaaaacaactacggggtgaagagcgtggggcagggatactctgtgggccaatccatgagactgggcttaggaggcaacgcccccgtgtctataccacagcagtcccagtccgtcaagcaacttctgccaagcggcaatggtcggtcctacggtttggggtccgagcaacggagccaggcccctgcacgctactcactgcagtcggcaaatgcttcctccctcagcagcggccagctaaagtcaccctcactgtcacagtcgcaggccagcagagttttaggccagtcctcttccaagcccgcagcagccgccacgggtccacctcctggaaatacttcatccacacagaagtggaagatatgcactatttgtaatgagctgttcccggagaacgtgtactccgtgcattttgagaaggagcataaggccgagaaagtgcccgccgtggccaattatatcatgaagattcacaatttcacctcgaagtgcttgtactgtaaccggtatctgcccaccgacacccttcttaatcacatgttgatccatggcctgagctgtccgtactgtcggagcacctttaatgacgttgagaagatggcggctcacatgcgtatggtgcatattgatgaggaaatgggacctaagaccgacagcaccctcagtttcgatctgacattgcaacaggggtctcacacaaatatccacttgcttgttaccacttataatttgagggatgcaccagcagagtcagttgcatatcacgctcagaacaaccctcccgtgccccctaagcctcagcctaaggttcaggaaaaagcggacattcccgtgaagagcagccctcaggcagcggttccttataaaaaggacgtggggaagaccctgtgtccgttgtgcttttccatcctgaaggggcccattagcgatgcccttgcccaccatttgagagaacgccatcaggtgatccagactgtacatccggtggaaaagaagctcacgtataaatgcattcattgcttgggggtttatacctctaatatgacagcctccacgatcacccttcacctggtacattgccgaggtgtaggcaagacacagaatgggcaggacaagactaacgctccttctcggcttaaccaaagccctagcctggcccccgtcaagcgtacctacgaacagatggagttcccattgcttaagaaacgtaagttagacgatgactctgacagtccgtctttctttgaggaaaagcccgaggaacccgtggtgttggcccttgaccctaaaggccacgaagacgatagctatgaggcccgaaagagcttcttaacaaagtacttcaacaaacaaccgtacccgacccggcgcgaaattgagaagttggctgcctccctatggctgtggaagtcagatattgcaagccactttagcaacaagcgtaaaaagtgcgttagggactgcgagaagtacaaaccaggggttcttttgggcttcaatatgaaggaacttaataaggtgaaacatgaaatggactttgacgctgagtggttattcgagaaccacgacgaaaaggacagtagggtcaatgcaagcaaaactgctgataagaaactgaacctgggaaaagaagatgactcctcttccgactcatttgagaacctcgaagaggagagtaatgagagcggctcaccattcgatcccgtgttcgaggtcgagccaaaaataagtaacgataatccagaagagcatgtcctgaaggtgatccccgaggacgccagtgagagcgaagaaaagctggatcagaaggaggatggttcaaagtatgagactattcatttgacggaggaaccaactaagcttatgcacaacgccagcgattccgaagtggaccaggacgacgtggtggaatggaaagatggcgccagcccatcggagtcaggacctggatctcagcaggtgagcgattttgaggacaacacgtgcgaaatgaaacctggtacatggtcagacgagagttcacaatcagaggacgcaagaagtagcaagcccgcagccaagaagaaagctaccatgcagggtgatcgggaacaactgaaatggaagaacagtagttatggcaaagtggagggcttctggtcaaaggaccagtcacaatggaaaaacgctagcgagaacgatgaacgtctgtctaacccacagatagaatggcagaatagtacgatagactctgaggatggagaacaatttgataatatgacagatggcgtggccgagcccatgcatgggtcccttgcaggcgtaaagctatccagccagcaggcctag

SEQ ID NO: 2300 - DNA, 3309 bp, Artificial Sequence
  Description of Artificial Sequence: Synthetic coding sequence
atgttccagctgcccgttaataatctggggtcactgaggaaagctcgtaagactgtcaagaaaattctgtcagacatcgggttggagtactgtaaagagcacatcgaagacttcaagcaattcgaaccaaacgatttttatctgaaaaacacaacttgggaggacgttggtctctgggaccccagtcttacaaagaaccaggattatcgaacgaagccgttctgttgttctgcttgtccgttttcaagcaaatttttctccgcttacaaaagtcacttccgaaatgtgcactcagaagacttcgaaaacagaattctgcttaattgcccctactgcacctttaacgccgacaagaaaacccttgaaacccacattaaaatcttccacgccccgaacgctagcgcgccaagtagcagtctcagtacatttaaggacaaaaacaagaacgatggcctcaagcctaaacaggccgactccgtggaacaggccgtgtattactgcaagaaatgcacatatagagatccactgtatgaaatcgtcaggaagcacatataccgggagcactttcaacacgtagcagccccttacatcgccaaggcaggcgaaaagtccttgaacggagccgttccgctcggatccaatgcaagagaagaatcatcaatccattgtaagagatgtctgttcatgccgaagtcctatgaggccctggtccaacacgttattgaggaccatgagcgcatcggataccaggtgaccgctatgataggccacacaaatgtggtggtgccacgtagtaagcctttaatgttgattgctcccaagccacaagacaaaaagagtatgggtctcccgccacgaatcggctcgctggcctcaggcaacgtgagatcactgccctcgcagcagatggtgaaccgcctttctatacccaagcctaatttaaactcgacaggagttaacatgatgagttccgttcatctgcagcaaaacaactatggcgtcaaatctgtgggccagggctattctgtcggtcagagtatgaggcttggtctaggcgggaacgctcctgtgtccatacctcagcaaagtcagtcagtgaagcagctcctgccaagtggaaatggtcgatcttacggtctgggcagcgaacagcggagccaggcacctgcccgctactctctgcaaagcgccaacgcatccagcctgagctcaggccagttgaagtcgccgtcgctgtcgcaatcccaggcttcccgggttctaggccagtcttcctccaagccggctgccgccgcgaccggcccgcctcctggaaacaccagttcaactcagaagtggaagatttgcaccatttgcaatgagctgtttcccgagaatgtctactccgtgcattttgaaaaggaacacaaagccgagaaagtgccagctgtggccaattacattatgaagattcataacttcactagtaagtgcctgtactgtaacagatacctgcccacagacacacttttaaatcacatgctcattcacggactgtcctgcccctactgtagaagtacctttaatgacgtcgaaaagatggcagcacacatgaggatggtccacatcgacgaggagatggggcctaaaaccgattcaaccctatcgttcgacttaaccctgcagcagggttctcacaccaatatacacttgctagtcacaacttataatcttagggacgccccggctgaatctgttgcctaccacgcacagaacaacccccccgtcccccccaagccacagccgaaagtgcaggaaaaggcagatatccctgtgaaatcgagcccacaagctgcagtaccttataaaaaagatgtggggaagaccttgtgcccactctgctttagcatactcaagggtcccatttccgacgctctagcacatcatctcagggaacggcaccaggttatccagacagttcatcctgtggaaaaaaagctgacctataaatgcatccattgtctgggagtgtatacaagcaatatgacagcatccaccatcacactgcacttggtgcattgcaggggagttggcaaaactcagaacggccaggacaagacaaatgctccgtccagactcaatcagagcccatcactagcccccgtgaaaagaacctatgaacagatggagtttccattgctcaagaagcggaagctggacgatgactcagatagtccctcctttttcgaggagaaacctgaagagccagtggtcctggcgttggatcctaagggtcacgaggacgatagctacgaagcaagaaaaagctttctgacaaaatattttaataaacaaccctatcccacacgacgtgagatcgaaaagctggctgcttccttgtggctgtggaagtcagacatcgcctctcacttctcgaataagagaaagaagtgtgtgcgggattgcgagaagtataagccgggcgtgctgttgggtttcaacatgaaagagcttaataaggtgaagcatgagatggattttgacgccgagtggctgttcgagaaccacgacgaaaaagactctagagtgaacgcctcaaagacggccgacaagaaattgaacctagggaaagaggatgattcatctagcgacagtttcgaaaacctggaagaagagtccaatgagagcggaagccctttcgaccccgtctttgaggtggagccgaaaattagcaatgacaatccagaagaacatgtactcaaggtgattcccgaggatgcctccgaatccgaagagaagctagatcaaaaggaagacggatctaagtacgagactatccacctgacagaagaacctactaaactcatgcataacgcctctgacagcgaggtggaccaggatgatgtagtagaatggaaagacggcgcctcaccctccgagagcgggccaggaagccagcaagtgagtgattttgaagataatacctgcgaaatgaaacccggaacatggagtgacgagtccagtcagtccgaagacgccaggtctagcaaaccggctgccaagaaaaaggccaccatgcagggggatagggagcagctgaaatggaagaacagcagctacggaaaggtggaaggcttttggtcaaaggatcagtcccagtggaagaacgcctctgagaatgacgaaagactctctaacccgcaaattgagtggcagaatagcaccattgattccgaagacggagagcaattcgataatatgaccgatggcgtggccgagcctatgcacggatccctcgctggagtgaagcttagttcacaacaagcatag

SEQ ID NO: 2301 - DNA, 3309 bp, Artificial Sequence
  Description of Artificial Sequence: Synthetic coding sequence
atgtttcagctccccgtgaacaatctgggttctcttcgcaaagcgcgcaaaacagtcaaaaagatcttatccgatatcgggttggaatattgcaaggagcacattgaagattttaagcagttcgaaccgaacgatttttacctgaagaacaccacatgggaggacgtcggtctgtgggacccaagtctcaccaagaatcaggattatcgaacaaaacccttctgttgctctgcgtgtccattctcatctaaattcttttccgcctacaagtcccacttcagaaacgtccatagcgaagacttcgaaaatcgcatcctactgaactgtccctactgcacatttaacgccgacaagaaaacccttgagacgcacattaagatattccacgcccctaacgcctctgctccgagttcaagcctgagtacattcaaggataaaaacaagaatgacggcctgaagcccaagcaggcagattccgtggagcaggctgtttactactgcaagaagtgcacttatagagatcctttatatgaaatcgtgcgcaagcacatctatagggagcatttccagcatgtggctgctccatatattgctaaggccggtgaaaagtctttaaatggtgctgtgccactgggaagcaatgcccgcgaggagagcagtattcattgcaaacgatgtcttttcatgccaaaaagttacgaggcgctggtgcagcacgtaatcgaggaccacgaaagaataggataccaggtaaccgccatgatcgggcatacaaacgtcgttgtgccgcggtctaagcccctcatgctgatcgccccaaagccccaagataagaaatcaatgggcctgccccctcgcattggcagcctcgctagtggaaatgttcgctccctgccctctcagcagatggtcaacaggctgagcatccccaagccaaacctgaattccaccggagtaaacatgatgtcctctgtgcacctgcagcagaataattacggtgtgaaatctgtggggcaagggtacagcgtcggccagagcatgcgtttaggcttaggaggcaacgctcccgtgtccattccgcagcaatcccagtcagtgaaacagttgctcccctctggtaatggtaggagctacggtctgggtagcgagcagcggtcccaagcccctgcccggtatagccttcagagcgctaatgcatcttcactgtccagcggtcaactcaaatcaccgagtctaagccagagccaggcttctcgggttctaggccagagtagtagcaagcctgccgctgctgcaacaggaccacctccgggtaatacatcttcaacacagaagtggaagatatgtacaatttgcaatgagctttttcccgaaaatgtgtacagtgtgcacttcgaaaaggaacataaagcagaaaaagttcctgccgtggccaattatatcatgaagattcataacttcactagcaagtgtctgtactgtaaccggtatctgcctacggacactctgttgaatcacatgctgatccacgggctttcctgtccgtactgtcgatcaacgtttaatgatgtggagaaaatggccgctcacatgcggatggtccatattgatgaggaaatggggcctaagacagatagtactttgtctttcgatcttactttacaacagggctcccacaccaatattcacttgttggtgactacctataatctgcgggacgctcctgccgaatcagtggcctaccatgcacagaacaacccccccgtgccccccaagccgcagccaaaagtgcaggagaaagcggacataccggtcaagtcttcaccacaggcagccgtgccctataaaaaggacgtggggaagaccctctgcccgttgtgcttttcgatcctgaagggtccaatctcggatgccttagcccaccatctcagggaaagacaccaggtcattcagaccgtccatccagttgagaaaaagttgacttacaaatgcatccattgcctgggcgtctatacttctaatatgactgcgagtaccattactttgcacctggttcactgccgcggggtgggaaagacccagaatggccaggacaaaacaaacgcaccttctcgcctaaaccagagcccttccctggctcccgtgaagaggacatatgaacagatggaatttccactactcaagaagagaaagttagatgatgactccgacagcccctctttctttgaagagaaacctgaggagccggtggtgttggccttggacccgaagggccatgaagacgacagttatgaagcccggaaatcatttctcacaaaatatttcaataaacaaccctatcccaccaggcgcgagatcgaaaagctggccgcatccctgtggctgtggaaatctgacattgcaagccacttctcaaataagcgtaagaaatgtgtgcgcgattgcgaaaagtacaaacccggagtcctcctgggtttcaacatgaaagagttgaacaaggtgaaacatgaaatggactttgacgctgagtggctgtttgagaatcacgatgaaaaggacagtcgcgtcaatgcttccaagaccgcagataagaaactcaacctgggcaaggaggacgattccagcagcgatagcttcgagaatcttgaggaagagagcaatgaatctggatcaccttttgatccggtgtttgaggtggagcctaaaatcagcaatgacaatcctgaagaacatgtgttgaaggttatcccagaggacgccagtgagagcgaagagaagctcgaccagaaggaggacggatctaaatacgaaaccattcacctcacagaagaacccaccaagttgatgcacaatgcttcggacagcgaagtggatcaggacgacgtagttgagtggaaagatggtgcaagcccttcagaaagcggccctgggtcccagcaggtgtccgactttgaggacaacacctgtgaaatgaagccaggaacgtggagtgatgaatctagtcagtctgaggatgcccgctccagcaagccggctgcaaagaaaaaggccactatgcagggcgaccgggaacagttgaaatggaagaatagttcctacggtaaggtcgaggggttctggtcgaaagaccagtcccagtggaaaaacgctagtgagaacgatgagagactatctaaccctcagatcgaatggcagaactccaccattgattctgaggacggtgagcagttcgataatatgactgacggtgtggcggaaccaatgcacggctcgctcgctggggtgaagctatcctcgcagcaggcctag

SEQ ID NO: 2302 - DNA, 522 bp, Artificial Sequence
  Description of Artificial Sequence: Synthetic coding sequence
atgtttcagttacccgtgaacaacctaggtagtctccgcaaggcccgaaaaacagtgaaaaaaatcctgagcgacatcggactggagtattgtaaggaacacatcgaggattttaagcagtttgaaccaaacgacttttatttaaagaatactacatgggaagatgtgggcttgtgggacccaagtctcacaaaaaaccaagactatagaaccaaacccttttgttgcagcgcttgtcccttcagtagcaagttcttctccgcttacaaatctcatttccggaatgtgcattccgaggacttcgagaatcgtattttactgaactgtccttactgcacattcaatgctgataaaaagactcttgagacccacataaagatcttccatgctccgaacgcatcagctccctctagttccctttccacatttaaggacaaaaataaaaacgatgggctcaagcctaaacaggccgacagcgttgagcaggctgtgtactattgtaaaaaatgcacatatcgctag

SEQ ID NO: 2303 - DNA, 441 bp, Artificial Sequence
  Description of Artificial Sequence: Synthetic coding sequence
atggtgatcctgacagagccagagggtgcacccaacatcactgctaacctcacatcatctctgttgtcggtttgtggttggtcccagacaatcaaccctgaagacgatacagaccccggacacgccgatcttgtcctctacataactaggttcgacctcgaactgccagacggaaatcggcaagtcagaggcgtcactcaactcggtggcgcctgcagtccaacctggtcctgcctgatcaccgaagacactggctttgacctgggcgtcacaatagcccatgaaatcgggcaccgcatttgcgcccgcccttctcctgctacccagacacgatggacgaaggctgcagccgccgcaagctcgttcctgtcctggatgggccagaatgtagcctggagatctggtgcgcctcgtgtcgccgccgctccctggtggtcatag

SEQ ID NO: 2304 - DNA, 4116 bp, Artificial Sequence
  Description of Artificial Sequence: Synthetic coding sequence
atgcaccagcgtcatcctcgcgccaggtgtcccccactgtgcgtggccggtatcctggcgtgcgggtttctacttggctgttggggaccatcccatttccaacagagctgtttgcaagcgctagagccccaggccgtgtcctcctatttgtcacctggcgccccattgaagggcaggcctccatcccccggctttcagcgccagcgacagagacaacgcagagccgccggcggcatcttgcacctagagcttctcgtcgccgtgggacctgacgttttccaggctcaccaggaggacacggagcgctatgtgctgaccaatttgaatattggtgccgagttgctgagagatccatcccttggagcccagttccgggtccatctagttaaaatggttatcctaactgaaccggagggcgccccaaatataactgcgaacttgactagttcccttctgagcgtttgcggatggagtcagaccatcaatcccgaggacgatacagatcccggccatgccgatctcgtgttgtatattactcggtttgacctggaactcccagacggcaaccggcaggtccgcggagttacccagttagggggggcttgctcccctacctggagctgtcttattaccgaggacacaggcttcgatctcggcgttacaattgcacacgagatcggtcacagcttcggcctggaacatgatggagcaccaggaagcggctgcggcccctctggacacgttatggcctcggatggggccgctccccgcgccggtctggcctggagcccatgctcgcggaggcagttgttgtcactcctgtctgctgggagggcccgatgtgtgtgggatcctcccagaccccagcctggaagtgccggccaccctccagacgcccagccaggtctgtattattcagcaaacgaacagtgcagagtggcattcggacctaaggctgttgcctgcactttcgcgagggagcatttggatatgtgccaggccctgtcatgccacaccgaccccctcgaccaatcatcgtgttctagactactggtgcccttgctggacgggactgaatgtggcgtggaaaagtggtgctccaaaggcagatgcaggagcctggtggagttaacccctatcgccgccgtacacggtcgctggagttcttggggcccccgcagcccatgttcgaggtcctgcggcggaggagtggtgacccggcgacgccagtgcaacaatccgcgtccggccttcgggggtcgagcatgcgtcggtgcagacctacaggccgagatgtgcaacacacaagcctgcgaaaaaacccagctggaatttatgtcacagcagtgtgcccggaccgatggccagccgctaagatcctcacccggtggcgccagcttctaccactggggagctgcagttccccatagccagggcgacgccctctgcagacatatgtgcagagccattggagagtcttttataatgaaaaggggcgattccttcctggatgggacccgctgcatgccttctgggccacgcgaggatggcactctgtcattatgtgtgtcagggagttgcaggacttttggctgtgacggtagaatggatagccagcaggtctgggatagatgccaggtttgcggaggtgacaattcaacctgcagtccacggaaagggtcttttacagccggccgcgctagggagtacgtcaccttcctcaccgtcactccgaacttgaccagcgtctatattgccaatcataggccactctttacccacctggctgtgaggatcgggggcaggtatgtggtggcgggtaaaatgtccatttcacccaacacgacataccctagtctgctcgaagacggaagagtggaataccgggttgcactgactgaagaccggttaccgagacttgaagagattagaatctggggcccactccaggaagatgctgacatccaggtgtatcgtaggtacggggaggagtacggaaatttgacaaggccagacataacttttacatattttcaaccaaagccaaggcaggcgtgggtgtgggctgcagtgagaggaccctgctctgtctcctgtggcgcaggcttacgctgggtgaactacagttgtctggaccaggcacgaaaggagctcgtggagacagtgcaatgccagggcagccagcagcccccggcttggcctgaggcctgcgtccttgagccctgtcctccctattgggcagtgggcgacttcggaccatgtagtgcaagctgtgggggcggcttgagggagagaccagtgcggtgtgtggaagcgcaaggctccctgctgaaaacactgccacctgcacgatgtcgggctggcgctcaacagcctgcagtggctctggagacctgtaaccctcagccatgccccgctaggtgggaggtgtctgagcctagctcgtgcacctcagccggaggcgccggactcgcactggaaaacgaaacctgtgtgccgggagccgacggcctcgaggctccagtgactgaaggccccggtagcgtcgatgaaaagctgcctgccccagagccctgcgtcggcatgtcttgccctccagggtggggccacctcgacgcaacctcggccggcgagaaagcaccttcaccttggggtagtatcaggacaggagcacaagccgcgcacgtgtggacacccgccgccgggagttgctcagtgtcctgcggaagggggttgatggaactccgtttcctgtgtatggactctgccttgagagtgccggtacaagaagagctgtgtgggctagccagtaagcccggaagcaggagggaggtgtgccaggctgtgccttgcccagcaagatggcaatacaagctggccgcatgctccgtttcgtgcggaagaggggtagtgcggaggatactttattgcgctcgggcccacggggaagatgatggcgaagagatactcttagacactcaatgccaagggttgcccagaccagaacctcaggaggcttgctctctcgagccctgcccaccccggtggaaggttatgtcccttggaccatgtagcgcctcgtgtgggctcggaaccgctagaagatcagtggcttgtgttcagctcgatcagggccaagatgtggaggttgacgaggctgcttgtgcggcactggttagaccagaagcttccgttccctgcctgattgccgattgtacatacaggtggcatgtgggcacgtggatggagtgctcggtgagctgcggcgacggtatacaacggaggagggacacctgtctgggtccgcaggcgcaggctcccgtgcccgctgatttttgtcagcacttacccaaaccagtcactgtgaggggctgctgggctggaccgtgtgtaggacagggggcctgcgggagacaacacctggagcccacaggtactatcgacatgagaggccctggccaagctgactgcgccgtggcaatcggcaggcctttgggcgaagtagtaacattacgcgttctggagagttctttgaattgttcggccggtgatatgctactgctctggggcagacttacttggcgtaaaatgtgtagaaagctgttggatatgacattcagctcaaaaaccaacacgctggtcgttcggcaacgatgcggaagacccggcggaggggttcttcttcgttatggcagccaactggcccctgaaaccttttatagagagtgcgacatgcaactgtttgggccgtggggggagatagtgtcaccctctctgtctccagctacctcaaatgccggcggctgtagactgttcattaacgtggccccgcatgctagaatagccattcacgcccttgcaacaaatatgggggctggcaccgagggagccaatgcaagctacatcctaatacgtgatacacactctttgcggacaacagcctttcacgggcagcaggtactttactgggaaagcgaaagcagtcaggccgagatggaattttctgaggggttcctcaaagcccaggcttccctgcggggccagtattggacacttcagagctgggtgcccgaaatgcaggaccctcaatcttggaaaggcaaggaaggaacatag

SEQ ID NO: 2305 - DNA, 4023 bp, Artificial Sequence
  Description of Artificial Sequence: Synthetic coding sequence
atgcaccaaagacatccccgggcccggtgtccccctctttgtgtcgctggcattttagcctgtggcttcctcttgggttgttggggaccttctcactttcagcagtcctgcctgcaggcattagagcctcaggcagtgtcctcctacctgagccccggcgctccactgaaggggagacccccaagcccagggtttcagcggcaaaggcagcgacagcgaagggccgctggaggcattctgcatctggagctcctggtggcagttggaccagatgtctttcaggcacatcaagaggacacggaaaggtacgtcctgacaaatctgaacattggagccgagttgctgagggacccttcccttggcgctcagtttcgcgtccacttagtcaaaatggtgatccttacagaacccgagggggcccctaatatcactgccaatctcacttcatccctcctcagtgtgtgcggctggtcccagactattaatccagaggatgataccgatcctggtcacgccgatctcgttctatacattacacggttcgatttggaattgcctgacggcaatcgccaggtgcgcggagttacacaattgggtggggcgtgcagccctacctggtcttgccttattactgaggacacaggatttgacctgggggtgaccatcgcccatgaaatcggtcacagttttgggctggaacacgacggggcccctggctctgggtgcggaccatcaggacacgttatggccagtgacggtgctgcgccacgggctggactcgcctggagcccatgctcccgaagacagctgctgagcctgctcagcgccaacgagcagtgcagagtcgctttcgggcctaaggctgtggcttgtacttttgccagggagcacttggacatgtgtcaggccctgtcttgccacactgatcctctagatcagagtagctgtagccgactcttggtgccccttcttgacggcactgaatgtggggttgaaaaatggtgcagtaagggaagatgtaggagtcttgtggaactcacgcctatcgcagccgtgcacggcagatggagctcgtggggcccacgatcgccatgtagtcgcagctgcggcggaggggtggtgacccggaggagacagtgcaacaatccccggccggcattcggtggcagggcctgcgtcggagcagatctccaagctgaaatgtgcaacacgcaagcatgtgaaaaaacccagctagaattcatgtcccagcagtgtgcccggacagacgggcagcctttacggtccagtcctggcggggcctctttctatcactggggtgccgccgtcccccacagccagggagacgctctctgtaggcacatgtgtcgcgcaataggggaatcattcatcatgaagcgaggggactcattccttgatggaaccaggtgcatgccaagcggcccacgtgaggatggcaccctctccctgtgcgtgagtggcagttgtagaacattcggctgcgatggacgcatggattcacagcaggtgtgggacagatgtcaggtgtgcggtggcgacaactctacatgctcgccaagaaagggctcattcactgccggcagggcgagggaatatgtaaccttcctgacagtaacacctaacctaacctctgtgtatattgcaaaccatcgccctctgttcacccacctcgccgtgcgaattggaggccggtacgtagtcgcaggaaagatgagcatttctccaaataccacgtatcccagcctgttagaggatggccgcgtagaatatagggttgccctcacagaagatcgcctgccgagactggaagagatcaggatctggggacctctacaggaagacgccgacattcaagtgtaccgtcggtatggggaagaatacggcaacctgactcgcccagatatcacctttacatatttccagccaaagcccaggcaggcctgggtttgggctgccgtgagaggaccctgctccgttagttgcggagccggcctgcggtgggtcaattatagctgcctagaccaggcaaggaaggaactggtggagaccgtccagtgccagggctctcagcagccgcccgcctggcctgaagcatgcgtgctagaaccgtgtccaccctactgggctgtgggggatttcgggccctgttcagcctcttgcgggggcggactgagagagaggcctgtccggtgcgtggaagcccaaggatctcttctgaaaactctcccccccgcccggtgcagggctggagcgcaacagcccgcagtggccctggaaacttgtaatccccaaccgtgccctgcccgctgggaagttagtgaacctagtagttgtactagcgccgggggggcagggctcgccctcgaaaatgaaacctgcgttccaggagctgacggactcgaggctccagtgactgagggacccggaagcgttgacgagaagttgccagctccggaaccttgcgtcggcatgagctgcccacccggttggggccacctcgacgcaacatccgccggtgaaaaggccccatcgccatggggaagcatacgaacaggtgctcaggccgctcatgtttggacaccagcagctggctcctgctctgttagttgtggaagaggcctgatggaacttaggtttctgtgtatggatagtgcactccgggtccccgtgcaggaagagctgtgcgggctcgctagcaaaccagggagccgccgggaagtgtgtcaagcagtcccttgtcctgccaggtggcagtacaagcttgccgcatgctctgtgtcctgcggacgcggcgttgtgcggagaatcctatactgtgcccgagcgcatggagaggacgatggggaagaaatcctgctagacacacagtgtcaaggtctgccacgccccgaaccacaggaagcctgttccctggagccatgccctcccaggtggaaagtgatgagcctgggcccctgctctgcgtcttgtggtcttggaacggcccggcgaagcgtggcctgtgtccagctggatcagggccaggacgtggaagtcgatgaagcagcctgcgcagctctggtgcgccccgaagcctccgtgccctgcttgattgcggattgtacctatcgctggcatgtcggcacctggatggagtgctccgtgagctgtggagatgggatccaaaggagacgggacacctgtttgggtccgcaggcccaggcccctgtcccagctgacttctgccagcatctcccaaagccagtaaccgttcgtgggtgctgggccggcccctgtgtcggccagggagcctgtggccgccaacacctggagccgacaggaaccatcgacatgagggggcctggtcaggctgattgcgcagtcgctattggaaggccactgggagaagttgtgactctgagggtgctagaatccagtctgaactgctccgcaggagacatgctgctgctctggggccgtctgacatggcggaagatgtgcaggaagcttctcgatatgacattttcctctaagacaaacacactggtggtgaggcagcgctgcgggcggccagggggcggagtactcctgcggtatggatcccaactggccccagaaaccttttaccgtgaatgcgacatgcagttgtttgggccatggggcgaaatagtgagtccttctctgagcccagctacgagtaatgcaggtggttgtcggcttttcattaatgtcgctccacatgccaggattgcgatccatgctctggcaacaaatatgggcgcaggtacagagggcgcaaatgctagctacatcctgatacgggacacccattcactgcgtaccacagcttttcacgggcagcaagttctgtattgggagagtgagtcctcacaggccgagatggaattttctgaaggctttctcaaggctcaggcctctcttaggggccagtattggaccttgcagtcttgggtgcccgaaatgcaggatccccagagctggaagggaaaagagggaacctag

SEQ ID NO: 2306 - DNA, 672 bp, Artificial Sequence
  Description of Artificial Sequence: Synthetic coding sequence
atgcgagggccaggtcaggcggactgcgccgtcgccatcggtcgtcctttgggggaggttgtaaccctgcgggttctggaatccagcctgaattgttccgccggcgacatgctacttctgtggggcagattaacctggcggaagatgtgccggaagctgctcgacatgaccttctcgtctaaaactaacacgcttgttgttaggcaacggtgcggaagaccaggaggcggcgtgttgctgaggtatggaagccaactggcacctgagactttttatagggagtgcgacatgcaactattcggcccttggggcgagatcgtcagtccctccttaagtcccgcgacatccaatgcaggggggtgccggctgtttatcaatgtggcccctcacgccaggattgccatacacgctctggcaaccaatatgggtgctggaaccgagggcgccaatgcaagttacattctcattagggacacccactcactgcgcacgactgcatttcatggtcagcaggtactttactgggaatctgaaagcagtcaggcagagatggagtttagcgaaggctttctgaaggctcaggctagtctgagaggtcagtactggacccttcagagttgggtgccagaaatgcaggaccctcagtcatggaagggaaaggagggaacttag

SEQ ID NO: 2307 - DNA, 1035 bp, Artificial Sequence
  Description of Artificial Sequence: Synthetic coding sequence
atgcaccagcggcacccgagagccagatgcccacccttatgtgtcgcaggtatccttgcttgcggatttctgttagggtgttgggggccttcccactttcaacagagctgcctgcaggcattggagccccaagcagttagttcatacctctcaccaggtgcccccctcaagggcagaccccctagcccgggtttccagagacagcgacaacgacagagacgagccgccgggggtatcttgcacctcgagctactggtagcggtgggacccgacgtgtttcaggcacatcaggaggatacagagcgctatgtcctgaccaaccttaatataggcgcagaattgttgcgggacccttccctcggagctcagtttcgggtacatttggtgaagatggtgatcctcactgaaccagagggagcccccaatataaccgcaaacctgacctcttcactgctgagcgtctgcggctggagccagacaatcaatccggaagacgacaccgacccagggcacgccgacctggtgctgtatatcacaagatttgacctcgaacttcccgatggaaacaggcaagtaaggggagtgacgcagctgggcggcgcttgctctcctacctggagttgtctcattactgaggatactgggtttgacctgggcgtcacgattgctcatgagatcggccattcgtttgggctggaacacgatggtgcccctggaagcggatgtgggccaagcggccacgttatggcatctgatggcgctgcccctagggctggcctggcatggtccccctgttctcggcggcagctgctctctttgctaagacccgtaccaccatcccctttacccctactcgctacccacctctgtgcgggccgcagcctttcgctgggcccaagccaggaacccgcacctggcggcgggaggggtccccgaacccccgttcctacgcacaaaaggccaagattccagaccctgccttcgagctgccccctgctccggccagcaagctcccggtgcactccccgagattag

SEQ ID NO: 2308 - DNA, 831 bp, Artificial Sequence
  Description of Artificial Sequence: Synthetic coding sequence
atgcaccagaggcacccacgcgcccgatgtccgccactgtgcgttgcaggaatcttagcctgcggattcctactaggttgttgggggccttctcattttcaacagtcctgcctgcaggccttggaaccgcaggctgttagctcctatctttcaccaggagctcctctcaaaggtcggccccctagccccgggtttcagagacagcgccagcgccagcggagagccgccggcggaatcttgcatctggagcttctcgtcgctgtagggcccgatgtgtttcaggcgcatcaggaggacacagaacgctatgtgctgacaaatttgaacataggcgctgaattgctgcgcgacccttcattgggggcacagttcagggtccatcttgtcaagatggtaatcctgactgaacccgaaggcgcccctaatatcacagcaaatctgactagttctcttctgtctgtatgcgggtggtctcaaacaattaaccccgaagatgacacagacccagggcacgccgaccttgtactatacatcacccggtttgacctggagctgccggacgggaatcgccaggttaggggcgtaacacaactcggcggagcctgctcccccacctggtcctgcctgattactgaggacacaggctttgacttaggtgttaccattgcacatgagatcgggcatcggatttgtgccaggccatctcctgccacgcagactcgctggactaaggcagctgccgctgcgtcatcttttctgtcatggatgggacagaacgtcgcttggcggtctggagctccaagagtcgccgcagccccgtggtggtcttag

SEQ ID NO: 2309 - DNA, 4284 bp, Artificial Sequence
  Description of Artificial Sequence: Synthetic coding sequence
atgcatcagcggcaccctcgggctaggtgccctccattatgtgtcgctgggatattggcttgcggcttcctgctcggctgctggggccctagccattttcagcagtcctgcctccaggccctggaaccccaggctgttagctcatatttatcccctggcgcccccttgaagggacggccgccgagccctggtttccagcgtcaacgccagcggcagcggcgggccgcgggcggaattctacacctggagctgctagttgcagtgggccccgacgtgtttcaggcccaccaggaagataccgagcggtacgtcctcacaaatctcaacattggcgcagagctgctgcgagacccttcccttggagctcagttccgcgtgcacttggtgaaaatggtgattctaaccgagcccgaaggtgcaccaaacatcacagccaacctgacttcttcactgctgagtgtgtgtggttggtcccagactataaaccctgaagatgacacggatcccggtcatgccgacctcgttttgtacataacgagatttgacctcgagctcccagatggcaacagacaggtgcgcggtgttactcagctggggggggcctgcagccctacatggtcatgtctgatcaccgaggacacaggtttcgaccttggcgtgaccatagcacacgagataggacattctttcgggcttgagcacgatggcgccccaggatctggttgcggcccttctgggcacgttatggcatccgacggcgcggccccgcgtgctggattggcctggtccccttgcagcagacgccagttgctaagtcttctgtctgccggacgggctcggtgcgtgtgggacccccccaggcctcagccagggtctgctggccatcctcccgacgctcaacctgggctgtattactcggcaaacgagcagtgtagagtcgcattcgggcctaaagctgtcgcttgcacattcgcaagagagcacctggacatgtgtcaggcccttagctgtcatacagaccctctcgatcagtcgtcgtgttcaaggttgctcgtgccgctactggacggtacagagtgtggcgtggagaaatggtgctccaaagggcgttgccgctcactggtggaattgactccgatcgctgctgtgcatgggaggtggtcctcttggggacctcgctctccctgttccagaagctgcggcggaggggtagtcaccagacggcgtcagtgtaataacccccgcccggctttcgggggcagagcttgtgttggcgcagatttgcaggcggagatgtgcaatacccaggcgtgtgaaaaaactcaactcgagttcatgtcccagcagtgcgcaaggaccgatggacagccactgcgctcttccccgggcggagccagtttctaccattggggagcagccgtaccccactcccagggagatgcactgtgccgccacatgtgccgggcaatcggagaaagtttcattatgaagcggggagattcattcctcgatgggacccgctgtatgccaagtggaccccgtgaagacggcactctgtcactttgcgtctccggcagctgtcgcacttttgggtgtgacgggcggatggacagtcagcaagtctgggaccggtgccaggtgtgtggaggtgataactctacttgctccccacgaaagggatcgtttactgccggtcgtgccagggagtacgttaccttcttgaccgtgacaccaaatttgacttccgtctatatcgcaaatcacaggccactgttcacacacctggctgtcaggatagggggcaggtacgtcgtcgcgggcaagatgtccatttctccaaacacaacttatccatcccttctcgaagatggcagagtagagtacagggttgccctcactgaagaccggcttccacggctcgaagagattcgcatatgggggcctctgcaggaagacgccgacattcaggtctacagacgctacggcgaagagtacggaaaccttacgcgccccgacatcacatttacctatttccagcccaaaccaaggcaggcatgggtttgggccgccgtaaggggaccatgttccgtgagttgcggggccggtctacgctgggtgaactactcttgcctggatcaggctcgtaaggaattggttgagacggtgcagtgccaagggtcgcagcagcctccagcttggcccgaggcctgcgtactcgaaccctgtcctccctactgggccgttggtgactttggaccctgctcggccagctgtggcggcggccttcgtgagaggccagtgaggtgtgtggaggcccagggtagcctgcttaaaaccctgccccctgccaggtgcagagcaggggcgcagcaaccagcagtcgcattagagacctgcaacccacagccttgccctgccagatgggaggtgagtgagccttctagttgcacgtccgcaggaggcgccggattggcactggagaacgagacttgtgtcccgggggccgacggcttggaggcgcccgtgactgaaggacctgggagtgtggacgaaaagctgcccgctcctgagccctgcgtcgggatgtcctgtccgcccggctggggccatttggacgccacctcggctggggaaaaagcgccatctccctgggggtctatacgcaccggggctcaagctgcccatgtttggacaccagcagccggctcatgctctgtgtcctgtggaagaggcttgatggagctccgattcctgtgcatggactccgctctccgggtgccagtgcaggaagaactgtgtggcctcgcctccaaacccggctccaggcgggaggtgtgccaggcagttccgtgtcccgccaggtggcagtacaaacttgccgcatgtagcgtgagctgcggcaggggtgtggtgcggcgcatcctgtattgtgctagggcccatggtgaggatgacggcgaggagattctacttgatactcagtgccaggggcttccccggccagaaccacaggaagcatgctccctggaaccttgcccgccaaggtggaaagtcatgtcactgggcccttgctccgctagttgtggcctgggaaccgctaggagaagtgtggcttgtgtgcagctggatcaaggtcaggacgtggaagtggacgaggccgcctgtgctgctctggtgcgacccgaggccagcgttccctgcctgatagcagactgcacgtatcgatggcacgtagggacatggatggaatgcagcgtttcttgcggcgatgggatccaaaggcgccgcgatacttgtcttggtccccaagcgcaagctccagtgcccgccgatttttgccaacacttgccgaaacccgtcactgtgagagggtgctgggcgggcccatgcgtgggccagggaacaccttctctggtgccacatgaagaagccgccgcccctggccgtaccacagctacccccgcgggggcaagtctggaatggtctcaggccagaggcctcttattcagcccagccccgcagccacgcagacttctgccgggtcctcaagagaactcagtgcagagcagcgcttgtggccgtcaacatctagagccaaccgggaccatagatatgaggggaccaggtcaggcagattgtgcagtcgctatcgggcggcccctgggcgaagtggtgactcttcgggtactggagtcttccttgaactgttccgcaggcgacatgcttctactgtggggaaggctcacatggcgaaaaatgtgtcggaaactgctggacatgacctttagctctaaaaccaacacccttgtcgttaggcaacgttgtggacggcccggaggaggtgttctcctgagatacggcagtcaactcgctcccgagactttttacagagagtgcgacatgcagttattcggaccatggggtgaaatcgtctctccttcactgagtcccgcaaccagcaatgcgggcgggtgtcggctgttcatcaacgtggctcctcacgctagaatcgcgatacatgcactggcaaccaatatgggagctggcaccgaaggcgcgaacgcctcatatattctcatacgcgatactcacagcctccgcacaacagcctttcatggtcagcaagtcctctactgggagagtgagtcttcccaggccgagatggagttctccgagggatttcttaaggcacaggcctccttaagaggccaatattggaccctgcagagttgggtgcccgagatgcaggatccccagagttggaaggggaaggaagggacctag

SEQ ID NO: 2310 - DNA, 1095 bp, Artificial Sequence
  Description of Artificial Sequence: Synthetic coding sequence
atggacatgtgtcaggctctgagctgccacaccgatccactggaccagtcatcatgctcccgtctcctggtgccactactggacggcaccgagtgcggtgttgaaaagtggtgctccaaaggtagatgcagaagtttggtggagctgactccaatagctgccgttcacggacgctggtcgagttgggggccacgttctccttgttccaggtcgtgcggagggggagttgtcacaagaagacgccagtgtaataacccgaggcctgcgttcggagggcgggcctgtgtgggagctgacctccaggccgaaatgtgtaatacccaggcctgcgagaagactcaactagaatttatgtcccaacagtgtgcccggaccgatggccagccacttcgcagctccccgggaggagcgtcattttaccactggggggccgctgtcccacattcacagggagacgccctctgtcgtcacatgtgcagggccattggggagtccttcattatgaaacgtggagacagcttcctagacggcactaggtgcatgccatctggccctcgagaggacggcaccctttccctctgtgtgagtggctcctgtaggacattcggatgtgacggccggatggattcacagcaggtgtgggataggtgccaggtgtgcggcggcgataattccacgtgctcacctcgaaagggtagtttcaccgccggtagagcgagggaatacgtaacttttttgaccgtgacccccaatctcacttctgtgtacattgctaaccatagaccactgttcacccaccttgccgtaagaattggtggcaggtacgtggttgcgggcaagatgagcatttctcctaataccacttacccctctctactggaagatggccgggtggagtatcgagttgcactcacagaggataggctgcctcgcttagaagaaatacgcatatggggtcccctgcaggaggacgcagatattcaggtaggaggggtgcgcgctcagcttatgcatatttcatggtggtcccgacccggactgggtgagcgggatctctgtgcccgtgggcggtggccaggtgggtcatctgactag

SEQ ID NO: 2311 - DNA, 1095 bp, Artificial Sequence
  Description of Artificial Sequence: Synthetic coding sequence
atgccatatcagtatcccgccctgacacccgaacagaagaaagagctttctgatattgcccatagaatcgtggcaccaggcaagggtattcttgccgccgatgagagtaccggaagcatcgccaagaggctacagtccattggcaccgagaataccgaagaaaataggcgtttttatcggcaattgttgctcacagccgacgatagggtaaacccatgtatcggaggggtgatattgtttcatgagaccttgtatcagaaagccgatgatggaaggccctttcctcaggtgatcaagagcaagggcggcgtggtcggcataaaggtggataagggggtcgttcccttggcagggacaaatggtgagacaaccacgcaagggctggacggcctgtcagaacgctgtgctcagtacaaaaaagatggggcagattttgctaagtggaggtgcgtgttaaagattggtgagcacactccctcggcacttgctattatggagaacgccaacgtcctcgcccgctacgcatcgatctgtcagcagaacggaatcgtaccgattgtcgaaccagagatcctgcctgacggtgaccacgacttgaagagatgtcagtatgtgacggagaaggtgctggcggctgtatataaagcgctcagtgaccaccatatatacctggaggggaccttgttaaaaccaaacatggttactccagggcatgcctgcacgcagaaattctcgcacgaagaaatcgcaatggctacagtaactgccttaagaagaactgtgccacccgccgtgactggtatcactttcctgagcggaggacagtccgaggaagaggcctccatcaacctgaacgctataaacaagtgccccctgttgaaaccttgggctctgaccttttcctatgggagggctctgcaagcttcggcgctcaaagcttggggtgggaaaaaagaaaatcttaaggcagctcaggaagaatatgttaaacgggcccttgctaacagccttgcctgtcagggtaagtacactccatcggggcaggccggcgctgccgcatcagaatcgctgtttgtctctaatcacgcatactag

SEQ ID NO: 2312 - DNA, 1095 bp, Artificial Sequence
  Description of Artificial Sequence: Synthetic coding sequence
atgccataccagtacccagctctcacccccgagcaaaagaaagaactgagcgacatcgcacacaggattgttgcccccggcaagggcattctcgccgccgatgaatctaccggctctattgcgaagcgcctccagtcgatcggaactgagaacacagaggagaaccgcaggttctacaggcagctcttgctgaccgcagacgatcgtgtgaatccttgtattgggggagtgatcctgttccacgagacactttaccaaaaggcggatgatgggaggccattcccgcaggttattaagtcgaagggcggagtggtgggaatcaaagtggacaaaggagttgtgccactggcggggactaatggggagacgacaacccagggcctggatggcctgtcggagcgctgtgcacagtacaaaaaagatggcgctgacttcgctaagtggagatgcgtgctcaagatcggggagcacacaccaagcgccctcgccatcatggagaacgcgaacgttctcgctagatacgcctcaatctgccagcagaacggaattgttccaattgttgagcctgagattctgcccgatggagatcatgacctgaagcggtgccagtacgtgacagaaaaagtgctcgccgctgtgtataaagccctgtctgaccatcatatctacctggagggaactctcctaaagcccaacatggttacacctgggcatgcgtgcacacagaaattctctcacgaagagattgccatggcgacagtgacggcgcttcgcaggacagtgccgccagcggtcacgggaatcaccttcctgagcgggggacagagtgaagaggaggcctctataaatctgaacgccattaataagtgtcctcttttaaaaccctgggcactaacattctcctatgggcgcgctttgcaggcaagtgccctgaaggcctggggagggaagaaggaaaacctaaaggccgcgcaggaggagtatgtgaaacgggcgttggcaaatagcctggcctgccaaggcaagtacacccccagcggccaggccggtgctgcagcatcggagtcattgtttgtgtccaatcacgcctactag

SEQ ID NO: 2313 - DNA, 1257 bp, Artificial Sequence
  Description of Artificial Sequence: Synthetic coding sequence
atggcccggagaaaacccgaaggctctagttttaacatgacacacctttctatggctatggcgttttccttcccccctgtggcaagcggacagcttcaccctcagttggggaacacccagcaccagactgagctgggcaaggagctcgccacgaccagcacaatgccataccagtacccagctctgactcccgagcagaagaaggagctgagtgacattgcccaccgtatcgtggctccaggcaaaggcatactcgccgccgacgagagtaccgggtctattgccaaaagactccagagcatcggcaccgaaaacacagaagaaaaccgccgattttatcggcagcttctccttactgccgacgaccgcgtgaacccttgtatagggggggtgatcctattccacgagactttatatcagaaagctgatgacggcagaccattcccccaggtcatcaagtccaagggaggcgtggtggggattaaggtcgataagggcgttgtccccctcgcaggcactaatggagaaacgacgacacagggcctcgacggcctctccgagcggtgtgcgcagtacaagaaagacggtgccgacttcgctaaatggcggtgcgtactcaaaattggcgagcatacaccatccgctcttgcgattatggagaacgcaaacgtcctcgcgaggtacgcctccatttgtcagcagaacggaatcgtgcctatcgtggaacccgaaattttaccagatggggaccacgacctgaagcggtgtcaatatgttacagagaaggttctggccgccgtgtataaggcactgtcagaccaccacatatacctggagggaaccctgttgaagccaaacatggtgaccccgggccacgcttgcacacagaaattcagccatgaagagatcgccatggccaccgtgaccgctctcagacggaccgtacctccagctgtcaccgggattacattcctgagcgggggccagtccgaagaagaggctagtataaatttgaacgcaattaacaaatgcccccttctcaaaccatgggcgctcacatttagctacggacgagccctgcaggcttctgcacttaaagcctgggggggcaaaaaagagaacctcaaagcagcccaggaggagtacgtgaagagggccctcgctaactctctcgcatgccagggcaaatacacccccagcgggcaggcaggagcagccgcttcagaaagtctctttgtgtccaatcacgcatactag

SEQ ID NO: 2314 - DNA, 1095 bp, Artificial Sequence
  Description of Artificial Sequence: Synthetic coding sequence
atgccctatcaatatccagccctgactccagaacagaagaaggaactatccgacattgcccatcgtatcgtcgccccaggaaagggcattctggctgccgatgaaagtaccggcagtatagccaaacgactgcaatccatcggtaccgaaaacaccgaggagaaccgccgattttatcggcagctcctgctcaccgctgacgaccgagtgaacccttgcattgggggggttattctgtttcacgagacactgtaccagaaagcagatgacggtcggccgttcccccaagtgatcaagtcgaaggggggagtcgtgggcattaaggtcgacaaaggggtggtgccactcgcaggcacaaacggtgagacaaccacacaaggcctcgatggtttatcagagagatgtgcacagtataagaaagatggggcggacttcgccaagtggcgttgtgtgctgaaaataggtgaacatacaccctccgccttggccatcatggagaatgccaatgtgttagcaagatatgcctcaatctgccagcagaatggaatcgtgcctatcgttgagcctgagattttgcccgacggagatcacgacctcaagagatgccagtatgttaccgagaaggtcctggccgctgtatataaggccctttccgatcatcacatctatcttgaaggtacacttctcaaacccaacatggtgacacctgggcacgcgtgcacacagaagttctctcatgaggagatcgcaatggcaacggtgaccgccttaagacggacagttccccctgctgtcacaggcatcacgtttctgagtggagggcagagtgaagaagaagccagcattaatttgaacgcaatcaataagtgtcccttgttaaagccgtgggcactgaccttcagctatggccgggccctccaggcaagcgcactaaaagcttgggggggcaaaaaggaaaatctgaaagctgcccaggaagaatacgtaaagcgggccctcgccaatagtctggcttgtcagggaaaatacactccttctggtcaggcgggagctgctgcgtcggaaagccttttcgtgtccaatcatgcttactag

SEQ ID NO: 2315 - DNA, 1095 bp, Artificial Sequence
  Description of Artificial Sequence: Synthetic coding sequence
atgccatatcagtaccctgctcttacccccgagcagaaaaaagagctaagcgacattgcgcatcggatcgttgctcccggaaaaggaatcctggccgcagatgagagtacgggttccatcgccaaaagattgcagagtataggaaccgagaacaccgaagagaatcgtcggttttatcgacagctgttattaaccgccgacgacagggtgaatccctgtatcggaggagtgattctgtttcatgagacgttatatcagaaggcagatgacggaaggccattcccgcaggtcataaaaagcaaaggcggtgtggtggggattaaagtggacaagggcgtagttccactggcgggaacaaacggagaaaccactacccagggtttggatggcctttcagaaagatgtgctcaatataagaaggacggagccgattttgccaagtggagatgcgtgctaaaaattggcgaacacacaccaagcgcactggctataatggaaaacgccaacgtgctagctcgttacgcttccatctgccaacagaacggaattgtgccgatcgtggagccagaaatcttacccgatggggaccatgatctaaaacggtgccaatatgtgaccgagaaggtgcttgccgcggtgtataaagccctgtctgaccaccatatctacctcgagggtacactgctgaagcccaatatggttactcccggtcacgcatgcacccagaagttttcacacgaggagattgcaatggcgaccgtgaccgctctgcggcgcaccgtccctccagccgtgacaggtattaccttcctttctggaggacagagtgaggaagaggctagtattaaccttaacgccattaataagtgccccttgctaaagccgtgggctctcaccttctcatatgggagagccctccaagctagtgcactgaaagcttggggcgggaagaaagaaaatctgaaggctgcccaggaagaatatgtcaagcgcgccctggccaactcactggcttgccagggcaaatatacacctagcggccaagcaggcgctgcggcaagtgaaagtctctttgtttctaaccacgcctactag

SEQ ID NO: 2316 - DNA, 1257 bp, Artificial Sequence
  Description of Artificial Sequence: Synthetic coding sequence
atggcaagacgcaagccagagggcagcagcttcaatatgacacacttatccatggctatggccttttcatttccacctgtggcctcagggcagctgcacccccagttgggcaacacccagcaccagaccgaactcggcaaggagcttgctaccactagcaccatgccatatcagtatcctgcgctcacgccagagcagaagaaagaactttctgacatcgcccaccggatcgtggcccctgggaagggtattcttgcagctgacgaaagcaccggctcaattgccaaacgcctccagtctattgggacggaaaatacagaggagaatcgacgcttttatcggcaactcctgctgacagctgatgaccgggtgaacccatgtatcggcggtgttattctgttccatgagactctttatcagaaggcagatgacggccggccgtttcctcaggtgatcaagtctaaaggcggcgtggtcggcatcaaagtagacaaaggggtggtacccctcgctgggaccaacggtgaaacaaccacccagggactcgacggcctaagtgaacggtgcgcccagtataagaaggacggagccgattttgcaaagtggagatgcgttttgaagatcggggagcacactcccagcgctctcgccattatggagaatgccaatgtgctggcacgttacgcctcgatttgccaacagaacggcattgttccgatcgtggagcccgagatcctgccagacggggaccacgatctgaaacgctgccagtatgtgacagagaaagtactggcagccgtgtacaaagcccttagtgaccaccacatctacctggagggtaccctcctgaagcccaacatggtcacacccggtcatgcatgtacacaaaagttcagccacgaagagatcgcgatggctacagtgactgcactccgccgaactgtgccacccgccgtaactggcatcacatttcttagtggagggcagagtgaggaggaagcatcgatcaatcttaatgctattaataagtgcccgcttctgaagccatgggcccttacgttttcctacgggcgcgccctacaggcgagcgccctgaaagcctgggggggcaaaaaggaaaaccttaaggcagcacaggaggaatacgtgaaacgggccttagcaaattccctagcctgtcagggcaagtatacacctagtgggcaggcgggcgccgctgcgtccgagtcgctgtttgtgagcaaccatgcctactag

SEQ ID NO: 2317 - DNA, 1095 bp, Artificial Sequence
  Description of Artificial Sequence: Synthetic coding sequence
atgccctatcagtacccggcactcacccctgaacagaagaaggaattgtctgatatagcccaccggattgtggctccaggtaagggcattctggcagctgatgagtcaaccggatctatcgccaagaggctacagtcaatcgggacagagaacactgaagaaaataggagattctatcggcagttgcttctcaccgctgacgatcgggtcaacccgtgcattgggggagtcattttattccacgagactttataccagaaggctgatgatgggagacctttccctcaggtcattaagagcaaagggggagtcgttggcattaaggttgacaagggtgtggtgcccttagcaggtaccaatggggaaaccaccacccagggcctggacggccttagtgagagatgcgcccaatacaaaaaggatggagccgacttcgccaagtggagatgcgtcctgaagatcggcgagcacacaccctccgcgctcgcgattatggagaatgccaacgtgctggctcgctacgctagtatttgtcagcaaaacggtattgtcccgattgtggaacccgagattctccccgatggagaccatgatctgaaaagatgccagtacgtcacagagaaggtattagccgcggtgtataaggccctgtcagaccaccatatctatctagagggtaccctgcttaagccaaacatggtgaccccaggtcatgcctgtacccaaaaattctcacacgaggagatcgcgatggccacagtcaccgccttgcgtcgcactgttcctcctgccgtgacagggattacttttctctccggcgggcagtctgaagaggaagcatccattaatcttaacgccattaacaaatgtcccctccttaagccatgggccctaactttctcctatggcagggctctgcaggcttccgctctcaaagcctggggcggaaagaaagagaacttgaaagctgctcaagaggagtacgtgaaacgggcactcgcgaatagtctggcatgccaaggcaaatataccccttctggtcaagccggagcagccgccagcgagagtttattcgtgagcaaccacgcctactag

SEQ ID NO: 2318 - DNA, 1344 bp, Artificial Sequence
  Description of Artificial Sequence: Synthetic coding sequence
atgtcggcctccaaaattccgctctttaagatgaaggacctgattcttattttatgtctgctggagatgtcattcgccgtaccattttttccccagcaaagcggtacacctggcatggccagtttatctctagagacgatgaggcagcttggctcactacagagactgaataccttgtctcagtactctcgctacggatttgggaagtcttttaactccctgtggatgcacggcctgctgcctccgcactcttcactgccctggatgagacctcgggagcatgaaacacaacagtatgaatattctctgcccgtacacccaccaccacttccatcacagcccagcctgaagccacaacagcctggactgaaacctttcctccaatccgccgcggctaccaccaaccaggccaccgcgctaaaggaggctttgcagccacctattcacctcggacatttgcccctgcaagaaggtgagcttccccttgtacaacagcaagtggcgccatctgacaagcctccaaaacccgaactccccggcgttgacttcgccgacccccagggcccttcgcttcctggcatggatttccctgatccacagggtcccagcctgccaggtctcgattttgccgatccacagggcagcaccatttttcagatagcgcgtctgatctctcacgggccgatgccgcagaacaaacagtcaccgctgtacccaggcatgctttacgtaccgtttggggccaaccagctcaacgcacccgcacggttgggtattatgagctctgaagaggtcgccggcggtcgcgaggatccaatggcttatggtgccatgttccccggattcggcggaatgcggcccggtttcgaaggcatgccacataatcccgcaatgggcggggacttcacactggaattcgatagcccagtcgctgctactaagggccctgagaatgaggaaggcggtgcgcagggttccccaatgcccgaggcaaatccagacaacctggagaacccagcattcctcaccgaactcgagcccgctcctcatgcaggcttgttagctctcccgaaagatgatattccagggctgccgcgatcaccctctggaaaaatgaaaggactgcccagcgtcacacctgccgcggcggatccccttatgaccccagagctggccgatgtctataggacctacgatgcggatatgactacctccgttgacttccaagaggaggccacaatggataccacgatggccccaaactcattacaaaccagcatgccaggcaataaagctcaggagcctgagatgatgcacgacgcctggcacttccaggaaccttag

SEQ ID NO: 2319 - DNA, 1299 bp, Artificial Sequence
  Description of Artificial Sequence: Synthetic coding sequence
atgagtgcttctaaaataccattatttaagatgaaagatctcatcctgattctttgtctcctggagatgtcatttgccgtcccctttttcccgcagcagtcgggaacccctggaatggcaagcctgagtctcgaaaccatgcgtcagctgggctctctccagaggcttaataccttgagtcagtattcacgatatggatttggaaagtcttttaatagcctctggatgcatggactgcttccaccacatagtagtttgccatggatgaggccacgggagcacgagacgcaacagcccagccttaaacctcagcaaccggggcttaaacccttcttacagtcggccgccgccactacaaaccaggccactgctctcaaggaggctctgcagcctccaatacatctgggacacctgccactccaggagggagaactgccgctcgttcagcaacaggtagcaccaagcgacaagccccccaagcctgagctgccaggagtcgattttgctgacccccagggcccatctctgccgggcatggactttccagatcctcaaggcccatccctgccaggcttagacttcgcagacccccagggaagtaccattttccagatcgcccgccttatctcgcacggcccaatgcctcagaacaaacaaagcccactgtatcccggtatgctttacgtgccgttcggtgccaaccagctgaatgcccctgccagactgggcattatgagcagtgaagaagttgccggagggagagaggaccccatggcttatggtgccatgttcccaggtttcggaggaatgcggcctggttttgagggaatgccacacaaccccgctatgggcggcgatttcacactagagttcgacagccccgttgccgccacaaaaggcccggagaacgaggaaggcggggcacaggggagcccaatgcccgaggccaacccagataatctggagaaccctgcctttctgacagaactggagcccgctcctcacgccggtctgctagcgttgcctaaggatgatattccaggcctgcccaggagtcctagcggaaagatgaaagggcttcctagtgtcacccctgcggctgccgatcccctcatgacaccggagctcgccgacgtctatagaacctatgacgcggatatgacaacatctgtggacttccaggaagaagctaccatggataccacaatggcaccaaacagcttgcaaactagcatgcccggtaataaggcccaggagcctgaaatgatgcacgatgcctggcatttccaggaaccatag

SEQ ID NO: 2320 - DNA, 1341 bp, Artificial Sequence
  Description of Artificial Sequence: Synthetic coding sequence
atgagcgctagcaagatccctctctttaaaatgaaagatctgatcctgattctttgtttactggagatgtcttttgctgttccattcttcccacagcagtcgggtacaccaggcatggcctcgctttccttagaaacgatgcggcagttggggagcctgcaaagattaaataccctgagtcagtacagcagatacggtttcggtaagtcattcaattccctgtggatgcatggcttgctaccaccccactcatctctcccttggatgcgtcctcgagagcacgaaacacagcagtatgaatactcgctacctgttcacccgccgccattacctagccagccatccctgaagcctcagcagcccggattgaagccatttcttcagtccgcagcagccacaactaatcaagccacagcactgaaagaggccctacaaccgccaatccatttagggcatctgccactccaggagggagaattacccctcgtccagcagcaggttgctcccagcgacaagcctccgaaacctgaactgcgcgtggactttgcggaccctcagggcccgagtctgcctggtatggacttccctgatccccaggggccctctttaccagggctcgacttcgccgatccgcagggatccactatcttccaaatcgcccggcttatctctcacggacctatgccccagaataagcagagcccactttatcctggcatgctgtacgtgcctttcggcgcgaatcagctaaacgcaccggcacggctcgggatcatgtcttcagaggaggtggctggagggcgagaagatccgatggcgtatggagctatgttccccgggttcggtggaatgaggccaggatttgaggggatgcctcataatcctgccatgggcggcgacttcacactggaatttgattcacccgttgccgcaacaaaaggtcctgagaacgaagaagggggggcgcagggttctcccatgccggaagccaaccccgacaacctggaaaacccagctttccttacagagctagagcccgctccccacgctgggctgctggccctgccaaaagatgatattcccggcctcccacgatcgccatccggaaagatgaaagggctgccatccgttactccggcagcagccgatcccctgatgacccctgaactagctgacgtgtacaggacttacgatgccgacatgacgacgtccgtggatttccaggaagaggcgactatggatacaacaatggcaccaaattctttgcagacctccatgccaggcaataaggcgcaggagcccgagatgatgcacgacgcctggcatttccaagaaccctag

SEQ ID NO: 2321 - DNA, 528 bp, Artificial Sequence
  Description of Artificial Sequence: Synthetic coding sequence
atgggaacctggatcctatttgcctgccttttgggggccgccttcgctatgcccgtgcttacgcccctgaaatggtaccagagcatacgacccccctacccatcttatggctatgagccaatgggaggttggcttcaccaccagatcattccagtcttgtctcagcagcacccgccaacacacactcttcagccccatcaccacatacccgtggtccctgcccagcagccagtcataccacaacagcccatgatgcctgtgcccggccagcacagcatgacacccattcagcatcaccaacccaacctgccacctccagcacagcagccataccaacctcagcctgtacagccccaaccccatcaaccaatgcagccacagcccccagtacatcctatgcagccactcccaccacagccacctttaccgccaatgtttcccatgcagccactgccccctatgttgcccgatctcaccttggaagcatggccgtcaaccgacaaaactaaaagagaggaggttgactag

SEQ ID NO: 2322 - DNA, 618 bp, Artificial Sequence
  Description of Artificial Sequence: Synthetic coding sequence
atggggacttggattctattcgcctgtctgcttggagctgcttttgccatgcccctgcccccgcaccctggacacccagggtacattaacttttcctacgaaaattctcatagccaggccatcaacgtcgacaggactgcacttgtactgacgcccctgaaatggtaccagtctatccgcccaccgtatccttcatacgggtacgagcctatgggaggctggctgcatcatcaaatcatccccgtattgtcccagcaacatcccccaactcacacacttcagcctcatcaccacattcccgtggtgccagctcagcaaccagtgatcccacagcagccaatgatgccagtccccggtcagcactccatgacccccatccagcaccaccaacctaatctaccaccccccgcacaacaaccttatcagccccagcccgtacaaccccagcctcaccagcctatgcagccacagccccccgtgcaccccatgcaacccttaccccctcagccaccactgcctccgatgttccctatgcagcctttacctcctatgcttcctgatctgaccttagaggcctggccaagcaccgacaagaccaagagagaggaagttgactag

SEQ ID NO: 2323 - DNA, 576 bp, Artificial Sequence
  Description of Artificial Sequence: Synthetic coding sequence
atggggacatggattctttttgcctgcctgttgggcgccgcattcgcaatgccactccccccccatcccggccatcccggctacatcaacttttcctatgaggtgttgaccccgctgaaatggtatcagtccattcggccaccatatccgagctatgggtacgaacctatgggcggctggcttcaccaccagatcatcccggtcctgtcgcaacagcacccccctactcacacccttcagccacaccatcatattcctgtggtgccagcccaacagcctgttatcccacagcagcccatgatgcctgtccctggacaacactccatgacccccattcagcaccaccagccaaacctcccaccgcccgcccagcagccatatcagcctcagcctgtgcagccgcagccgcatcaacccatgcagccacagcctcccgtgcatcccatgcagcccttgccgccccaaccgccgttgccacccatgttccctatgcagcctttaccccccatgttgcctgatctgacactggaagcctggcccagtaccgataaaaccaagagggaagaggtcgattag

SEQ ID NO: 2324 - DNA, 4023 bp, Artificial Sequence
  Description of Artificial Sequence: Synthetic coding sequence
atgtttcgggtcggcttcttgattatcagcagctctagcagtctgtcccctctgctcctcgtttctgtcgtgagagtgaataccacaaactgtcataaatgtctgttatcaggaacatatatttttgctgtccttctggtttgtgtggtcttccacagtggtgcccaggagaagaactacactatcagagaggagatcccggagaatgtgctgatcggtaacctgttaaaagacctgaatcttagcctcataccaaacaaaagtctgactaccaccatgcaatttaagcttgtgtacaagaccggcgatgtgcctctgattagaatcgaggaggataccggcgagatatttacgaccggggctcggatcgatcgcgagaagttgtgcgccgggatcccacgagatgagcactgcttttacgaggtggaagttgccatcctgcctgatgaaatttttcggctggtgaaaattagatttctgatcgaagatatcaatgacaacgctccgctgttccctgccactgtcattaacatctccattccagagaattctgccatcaattctaaatatactctgcccgctgcagtggatcccgacgtggggatcaacggggtgcagaactacgagctcattaaaagccagaacatcttcggcctggatgtgatagaaacacctgagggcgataaaatgcctcaacttatagtacaaaaagagttggaccgagaggagaaagacacatatgttatgaaggtaaaggtggaggatggggggttcccccagcgatcatcaaccgccatcttacaagtgtccgttaccgacacaaatgataatcacccagtgtttaaagaaacagagattgaggtgagtattccagagaacgccccggtcgggactagcgtgacccagctccatgccactgacgccgacattggggagaatgccaaaattcacttttctttctcaaacctagtaagcaatattgcgcgcaggttgttccaccttaatgctaccactggattgatcaccattaaggagccacttgatagggaggagacacctaaccataagctgctggtgctcgcaagcgacggtgggctgatgccagctcgtgcaatggtccttgttaacgtcaccgatgtcaacgataatgttccgtcaattgacattaggtacattgttaaccccgtgaacgatactgttgtgctgtccgaaaatatccctctcaacactaagatcgccctgattactgtcactgataaagacgccgatcacaatggcagggtcacctgttttaccgatcacgagatcccattccgccttagaccagtttttagtaaccaatttcttctggagaatgcggcctatctggactacgagtcaactaaagagtacgctattaaactgctggctgctgatgcaggaaagccgcccctaaaccagtcagctatgctgtttattaaagtcaaggacgaaaacgataacgcacctgtctttactcagtcgttcgtgaccgttagcattcctgagaataacagtcctgggatccagctgatgaaggtgtcggcgacggatgcggatagcggacccaacgccgaaattaattatctgctcgggcctgacgccccacctgagttctctctggaccgacggactgggatgctcaccgttgtaaaaaaactcgacagggagaaagaggataaatacctgttcaccatccttgccaaagacaatggtgtgcctccactgacctcaaacgtaacggtctttgtcagcattattgaccaaaatgacaacagtcctgtgttcactcataacgagtataagttttatgttcctgagaacttgcctcggcacggaaccgtaggcctgatcacagtgaccgaccccgattatggcgacaactcagcagtcactcttagtatactggacgagaacgacgacttcacgatcgacagtcagactggggtgatccggcctaacatttcttttgatcgcgagaaacaggaatcctatacattttatgtaaaagcagaggatggcggtcgggtatctcgtagcagttccgccaaggtgacaatcaatgtcgtggacgtgaacgataataaacccgtgttcatcgtgccgccctataactatagctacgagttagtcctgccatctacaaatcctggcactgtggtgttccaggtgatcgccgtggacaacgatacgggaatgaacgcagaggtgcgttactctatcgtcggcggcaataccagagaccttttcgctatcgatcaggagactggaaatattacactgatggagaagtgtgacgtgaccgatctgggactgcatagagtgctggttaaagcgaatgacctcggccagcctgatagcctttttagcgtggtcattgtcaatctgtttgtgaatgagtcagttactaacgcaacgttaattaacgagttggtgagaaagtctattgaggcccctgtgacacccaataccgagatagcagacgtgtctagtccaacttctgattacgtaaaaatcctcgtcgctgccgtggctgggacgattacagttgtggtggtcattttcattactgccgtcgttcgttgccgccaggcgcctcaccttaaagcagcccagaaaaacatgcaaaatagtgaatgggctacaccaaacccggagaacaggcagatgattatgatgaagaagaaaaagaagaaaaagaaacattctcccaaaaacctgcttctcaacgtcgttaccatcgaagagaccaaggccgatgatgttgattccgatgggaaccgcgtgactctggatctccccatcgatctagaggagcagacaatgggtaaatacaactgggtgactacccccaccacctttaaaccagattcccccgacctggctcgccattacaagtctgcatcgccgcaacccgcctttcagatccaaccagagacacccctgaaccttaaacatcacataatccaagaactcccgctggacaacactttcgtagcctgcgatagcatcagtaattgttcatccagctcctcagatccctactccgtgagcgactgtggctaccctgtgacaaccttcgaagttccagtctccgtgcatacaagaccatcacagaggagagtaaccttccacctgcccgaaggctctcaggagtctagctccgacggcggtctcggggatcatgatgcaggctccctgacgtctacgtcacacggtttgcctctcggataccctcaggaagagtacttcgatcgggccacaccctcaaatcgcaccgagggagatggaaactcggacccggagtcgaactttatcagcggcatgcgcgaaaagattactgtacagcctacggtggaagaggcctccgataactgcacacaggaatgcctgatatatggccactcagacgcttgctggatgccagcatcactcgatcatagcagttccagccaagcgcaagcgagcgccctatgccactcgcctcccctctcacaggcctccactcaacaccattcaccacccgtgacccagaccatagtgctttgccactctccacccgtaacccaaaccatcgccctctgccactcacctcccccaattcaggtatctgcgctccatcactcaccaccgcttgtgcagggtacggctctccaccacagtcccccttccgcgcaagcgtctgctctctgttacagtcccccgctagcccaggctgcggctataagccacagctcaagtctccctcaggtcatagcattgcaccggagccaggctcaatcgagcgtcagcctgcagcaggggtgggtgcaaggggccaatgggctttgttccgtggaccagggtgttcaaggctcagccacttcccaattttatacaatgagcgaaaggctgcacccctccgacgattccataaaggtaatacccctgactaccttcgccccccgccagcaagctcgtccaagccgtggggactcccccattatggagactcaccccttgtag

SEQ ID NO: 2325 - DNA, 621 bp, Artificial Sequence
  Description of Artificial Sequence: Synthetic coding sequence
atgggaacttggatcctttttgcgtgcctcgtcggagcagctttcgcgatgcccttgcccccccacccagggcaccctggttacatcaatttctcctacgagaatagccacagccaggccataaacgtcgatcgcatagccctggtgctaacccctctcaagtggtaccagtccatgattagacctccgtacagttcatacggatacgagccaatgggcgggtggctgcaccaccagattattccagtagtcagtcaacaacacccactcacacatactttgcagagtcaccatcacattcccgtggtcccagcccagcaacccagggtcaggcaacaagccctgatgccagtgcccgggcagcagtcaatgacacccacccagcaccaccaacccaacctgcccctgccagcccagcagcccttccaaccacagcctgtgcaaccccagccccaccagcccatgcagccacagcccccagtacagccaatgcagcctttattgcctcaaccacctttgcccccaatgttcccactgcgccctctcccgccaatcctacctgacttgcatctggaggcctggcctgccaccgataagaccaaacaagaggaggtagattag

SEQ ID NO: 2326 - DNA, 618 bp, Artificial Sequence
  Description of Artificial Sequence: Synthetic coding sequence
atgggaacctggatcctcttcgcttgtctggtgggagccgcttttgctatgcccctgcccccccaccccggtcaccccggttatatcaattttagttacgagaactcccactcacaggctataaacgtggacagaattgctttagtgctgacccctctgaagtggtaccagtccatgattcgaccgccttacagcagctacgggtatgaaccaatgggcggatggctgcatcaccagattatacctgtcgtgtcccagcagcacccactgacgcatacactccagagccatcatcacatacccgtggtccctgcccagcagcctcgcgtcagacagcaagctcttatgccggtaccgggccagcagtccatgacccctacacagcatcatcagcccaacctgccgcttccggctcagcaaccatttcagccacaaccagtacagccccagccccaccagcccatgcagccccagccccctgtgcagcccatgcagcccttgttgccacagcctcctcttcctcccatgttccccttgcggccgttaccccctatactccccgatcttcacctcgaagcgtggccagctaccgacaagacgaaacaggaagaggtgtag

SEQ ID NO: 2327 - DNA, 4599 bp, Artificial Sequence
  Description of Artificial Sequence: Synthetic coding sequence
atggggcattcaaaacagattagaatattattactaaatgagatggagaaactggaaaaaactctgttcaggctggagcaggggtacgaactccagttccgtttaggccctactcttcaggggaaagccgtgactgtttacactaattaccctttccctggagagacattcaatagggagaagttcagatctctcgattgggagaaccctacggaaagggaggatgattccgacaagtactgcaagttaaatctgcagcagtctggaagctttcagtattacttcctgcagggcaacgaaaagtccggaggcggctacatcgtagtagatcccattcttcgcgtcggggctgataatcacgtgctcccactcgattgcgtaacgttacaaacctttctcgcaaagtgtcttggccccttcgatgagtgggaaagccgactgagagtggcgaaggagtccggttacaatatgattcatttcacgccgctgcaaacactgggattgtctaggagctgttattctctcgctaatcagctcgaactcaatccagacttcagtcgtcccaaccgaaagtatacttggaatgatgttggccagcttgtggaaaagttgaaaaaggagtggaatgtgatctgtattacagatgtggtgtacaatcacacggcagccaatagtaaatggattcaagaacaccctgagtgcgcttacaacctggtgaattcaccccacctgaagcctgcatgggtgctggatcgggccctttggcgcttctcctgcgatgtagctgagggtaagtacaaggagaaagggattcccgcactaatagaaaacgatcatcatatgaatagtatccgaaagattatatgggaggatatattccctaaactgaaactctgggaattcttccaagtggacgtcaacaaggccgtcgagcagttccggcgattgcttacccaagaaaaccgtcgcgttactaaatccgaccccaaccagcatctcacaataatccaggaccccgagtacagacgcttcggttgtactgtggacatgaacattgcccttaccactttcattccccatgacaaaggtcctgccgccattgaagaatgctgcaactggtttcacaaacggatggaggagctcaattccgagaagcatagactgatcaattatcatcaggaacaggctgtgaattgcttgctgggcaacgtgttttatgaacggctggcggggcacggaccaaaactcggaccagtgacaaggaagcaccctctggtcactaggtactttactttcccttttgaagagattgacttcagtatggaagaatcaatgatccacctgccaaacaaagcttgctttctgatggcacacaatgggtgggtcatgggcgatgaccctctgagaaacttcgccgagcccggaagtgaggtctacctcaggagagagcttatttgttggggcgactctgtcaagctgcggtatggcaacaaaccagaggattgcccttacttgtgggctcatatgaaaaagtatacagaaataacagccacttatttccagggcgtcaggctcgataattgtcacagcacccccctgcacgtcgccgagtacatgctggacgccgccaggaatttgcagccaaacctatacgtcgttgccgagctgtttacagggtcggaggacctcgataatgtgttcgttactcgcctggggatctccagcctgatccgagaggccatgagcgcttataattcccatgaagaggggcggctcgtttaccggtatgggggggaacccgtggggtcatttgttcagccctgtttgcgacccttaatgcctgcgatcgcacatgcactgttcatggatatcacgcacgacaatgaatgccccattgtgcacagaagcgcatacgatgccctgccaagcaccacaatcgtctcaatggcctgctgtgctagcggcagcaccaggggctatgacgaactggtgccccaccagatctcagttgtgagcgaggaacgattctacaccaaatggaatcctgaggcactacctagcaacacaggggaggtgaacttccagtccggtataatcgccgcaaggtgcgctatctcaaagctgcatcaggagctcggtgctaagggttttatccaggtctatgtagatcaagtagacgaagatattgtcgccgtgacaaggcactccccctccattcaccagtctgtcgtcgccgtcagccggactgctttccgcaatcctaaaacctccttttacagcaaagaggtgccgcaaatgtgcatccctgggaaaatcgaagaagtcgtcctcgaggctaggaccattgaacgcaacactaagccttacaggaaagatgaaaatagtattaacggcacaccagacataactgtggaaattcgcgagcacattcaactcaacgaatcaaaaattgtcaaacaggctggtgtcgcaactaagggccccaacgagtacatacaggaaatcgagttcgagaatctgagtccaggcagcgtcatcatctttcgtgtgtccttggatccccatgcacaagtggcagtgggcatactgaggaatcacctaacccagttctcacctcattttaaaagtgggagtctggccgtggacaacgctgacccaatcttgaagatacccttcgcatccctggcctctcgattaacactagcagagttgaaccagattttgtaccgctgcgagagtgaggagaaggaggacggaggtggctgctatgacattcccaattggagcgcacttaagtatgcgggtctgcagggactgatgagcgtgctagcggagatccgcccaaaaaatgacctcggccatccgttctgtaacaacttgcggtctggcgactggatgattgactatgtgtctaaccgcctcatctcgcggagcggaaccatcgcagaggtgggtaagtggcttcaagctatgttcttctatctgaaacagatcccacgttacctgattccttgttatttcgacgccatactgataggcgcttacaccacgcttctcgatacagcctggaagcagatgtcttcattcgtgcaaaacggctcgacttttgtcaagcatctgtcattgggtagtgtccaactgtgtggcgtcgggaagtttcccagcttgcctattctctcacctgctctgatggacgtcccttatcggctcaatgagatcacaaaggagaaggaacaatgctgcgtcagtttggccgccggcctcccccacttcagcagtggtatcttccgatgttggggccgcgacacattcattgctctgaggggtatactactgatcaccggacggtatgttgaggcccggaatatcatactggccttcgctggaacactgcggcacggattgatacctaaccttctgggagaaggtatctacgccaggtacaattgccgcgacgccgtttggtggtggcttcagtgtattcaggattattgcaaaatggtgcccaatggcttggatattctcaagtgcccggtgtcccgcatgtacccaaccgatgattccgctcctctgcccgccggtacactcgaccagccactgtttgaggtcatccaggaggccatgcaaaagcacatgcagggcatccagttccgggaacggaatgcaggcccccagatcgataggaatatgaaagatgaaggcttcaacattacggcgggcgtggacgaggagacggggttcgtgtacggcggaaataggttcaattgtggtacgtggatggataagatgggcgagtccgatcgggctaggaatcgaggcattccagcgaccccacgagacgggagtgcggtggagatcgtgggcttgagcaagagtgccgtccggtggctgcttgaattgagcaagaaaaacatcttcccttaccacgaggtgacagtgaagcggcacggcaaagccattaaggtgagctatgatgagtggaatagaaagattcaagataactttgaaaaactgtttcacgtttccgaggaccccagcgatttgaacgaaaagcatcccaacctggttcacaaaagaggtatatacaaagatagctatggcgcatcgagcccctggtgtgactaccaactgcgccctaacttcacaattgcaatggtggtcgcccccgagttattcaccacagagaaggcctggaaggcactggaaatagcagagaaaaagctgttggggcccctgggaatgaagaccttggaccctgatgatatggtgtactgcggcatatacgacaacgcgctggacaacgataactacaatttggctaaaggttttaattaccaccaaggacccgaatggttgtggcccatcgggtactttctgagagctaagttgtacttttcccggttgatgggccctgaaactaccgccaagaccatcgtcctggtgaagaacgtgctttcgaggcactatgtccacctcgagcggtccccatggaagggcctgccagagttaactaatgagaacgcccaatactgtccatttagctgcgaaacccaagcttggtcaatagctactatacttgagaccctgtatgacctgtag

SEQ ID NO: 2328 - DNA, 4551 bp, Artificial Sequence
  Description of Artificial Sequence: Synthetic coding sequence
atggctccaattctttccattaatctgtttatcggctatgagctgcagttccggctcgggcccactctgcagggcaaggcggttactgtgtacacaaactaccccttcccgggcgagacctttaacagggagaagttccgttccctcgattgggagaatcccacagaacgagaggacgactcagacaaatactgcaagctcaacctccaacaaagcgggtccttccaatactatttcctgcagggcaacgaaaagtcgggagggggctacattgttgtggatccaatcctgcgggtgggagcagacaaccatgtgttgcctttagattgcgtgaccttgcagacgtttttggccaaatgcttggggccttttgatgagtgggagtcacgtctgcgggtggccaaagaatcaggctataacatgatccacttcacacctctgcagaccctgggcctttcccgctcatgctactccctggctaaccaattagaactgaatccggatttttcaaggcccaaccgtaaatatacttggaacgacgtcgggcagctggtcgagaagttaaagaaggaatggaacgtcatttgcattactgacgttgtgtacaatcacaccgcagccaattctaagtggattcaggagcacccggagtgtgcctataaccttgtgaactcacctcacctgaaacccgcttgggtactcgatagagcattatggcgattcagttgcgacgtggctgaggggaagtataaagaaaagggcattcctgcattgatcgagaacgaccatcacatgaactccatcaggaagattatatgggaggacattttccccaaacttaagctctgggagttcttccaagtcgatgtgaataaggcagttgagcagtttcgcaggctgttgacccaggaaaaccgccgtgtgacaaagtctgaccctaatcagcatcttactattatccaagatcccgagtacaggaggtttggatgtacagtcgacatgaatatcgccttgaccacatttataccccacgacaaggggccagcagccatcgaggaatgctgcaattggtttcataagagaatggaggaactcaattctgaaaaacaccgactgataaactatcaccaggaacaggcagtcaattgcctgctgggtaacgtgttctacgaaagattggcaggccacgggcccaagctagggccggttacaagaaagcaccccttggtgacgcgctattttacttttccgtttgaagagatcgatttttccatggaggagagcatgatccacctgcctaacaaggcatgcttcttaatggcacacaacggatgggtgatgggcgacgacccactcaggaatttcgcggaacccggatctgaggtgtaccttcgaagagagctcatctgctggggggattccgtaaagctgcgatacgggaataaaccggaagattgtccttacttgtgggcccatatgaagaaatacaccgaaattaccgctacctactttcagggtgtgaggctggataattgtcattcgacacctctgcatgtcgctgaatatatgctcgatgccgcaagaaatttgcagcctaacctgtacgtggttgcagagctgtttacgggatccgaggacctcgacaatgtttttgttactagactggggatttcatcactgatcagggaggccatgtctgcgtacaacagccacgaggaaggaaggctggtctataggtacgggggcgaacccgtgggctcttttgtccagccttgtctgagacctctcatgcctgccatagcccacgccctcttcatggatatcactcacgacaacgagtgccccattgtgcatcgaagcgcctacgacgcgttaccaagtaccactatcgtgtcaatggcatgttgtgcgagtggatcaacgcggggatatgacgaactggttccgcatcagatctcagtggtctctgaggaacgcttttacacgaaatggaatccagaagccctgcccagcaacaccggcgaagtgaacttccaatcaggcattatcgcagctcgctgcgcgattagcaagttgcatcaagagctgggggccaagggattcattcaggtctacgtggatcaggtggacgaagatatagtggcagttacccggcacagtcctagcattcaccagagcgtagtggccgtgagccgaactgcatttcgaaaccctaaaacttctttttactctaaggaggtaccccaaatgtgcatccccggcaaaatcgaagaggtggtcctggaagcccgtactattgagcggaacaccaagccttacaggaaggatgaaaactccataaacggcacgcctgacataacggttgaaatacgtgagcacatacaacttaacgagtccaagattgtgaaacaagcaggggttgctactaaaggccccaacgaatacattcaagagattgagttcgagaatctctcacccggcagcgtgatcatttttcgcgtatctttagatcctcacgcacaggtggccgtgggcatcctgcgcaaccatttaacccaattctcacctcacttcaagagtggcagtctcgccgtggataatgccgacccaatactgaagatcccattcgcttctctggccagtagactgacactagctgaactgaatcaaatcctctacagatgcgagtcggaagaaaaggaggacggtggtggctgttacgacatcccaaactggagcgctctgaaatatgcaggtctgcagggcctgatgtctgtgcttgctgagatacgccctaaaaacgacctggggcatccattttgcaataatctccgctcaggggactggatgattgactacgtgagcaacaggctgatctcccggtccggcaccatagccgaagtcggcaaatggctgcaggctatgttcttctatttgaagcagatacccagatacctcataccttgctattttgacgccatcctgattggggcctataccactctgctggacacagcctggaaacagatgtccagttttgtccagaatgggtctaccttcgtcaaacaccttagcttgggctccgtccagctgtgtggtgtaggtaagtttcccagccttcctatcctttcaccagccctgatggacgtgccataccggctgaatgaaatcacaaaggaaaaggagcagtgctgcgtgtccctggccgccggtcttccacatttctctagtggcatctttcgatgttgggggcgcgatacattcattgctctgcggggaattctgctcatcactgggaggtatgttgaagcccgaaacatcattctggcttttgcaggtacactgcgacacggacttatcccaaaccttctgggagagggtatttatgctcgctacaactgcagagacgcggtgtggtggtggttacagtgtatccaggactattgcaaaatggtgcccaatggcctcgatatcctcaagtgtccagtgtcccgcatgtatccaactgacgattctgctcccttgcccgccgggacactggaccagcccttattcgaggtcatacaagaagccatgcagaagcatatgcaagggatacaattcagggaacgtaacgctggccctcagatcgatcgaaacatgaaagacgagggtttcaacattactgccggtgtggatgaagagaccggattcgtatacggtggaaaccgctttaattgtggcacctggatggataaaatgggtgaaagcgatagggctaggaatcgggggattcctgccaccccccgcgacggctccgccgtggaaatcgtaggtcttagcaagtccgctgttagatggctacttgaattgtctaaaaagaatatcttcccataccacgaagttaccgttaagagacacggtaaagctatcaaagtgtcctacgacgaatggaacaggaagatccaagataatttcgaaaaattgttccacgtaagcgaggaccccagcgacctgaacgagaagcaccctaacttggtgcacaaaaggggaatttacaaagattcctacggagcatcaagtccatggtgtgactatcagttaagaccaaacttcaccatagccatggtggtagcccccgagctcttcaccacagaaaaggcgtggaaggctctagagatcgctgagaagaagctgctgggtcctttaggtatgaaaacgctagaccccgatgacatggtgtactgcggaatttatgataacgcattggacaacgataattataacctcgcaaaggggttcaactatcaccagggacctgagtggttgtggcctatcggctactttctgagggcaaaactgtatttctctcgcctgatggggccagagacaactgcaaaaacgatcgtgctcgtgaaaaatgttctctctcggcattacgtccacctggagagatccccatggaagggcttgccagagctgactaacgagaatgcccagtattgtcctttctcctgtgaaacacaggcttggagtatcgccacaatcctcgagaccctctacgatctttag

SEQ ID NO: 2329 - DNA, 4548 bp, Artificial Sequence
  Description of Artificial Sequence: Synthetic coding sequence
atgagcctgctgacttgcgccttctatctgggttacgaactccagttcagactcgggccaaccttgcaagggaaggccgtgacagtgtacaccaactatcccttccctggcgagacctttaatcgggagaaattcaggtcccttgactgggaaaaccccactgagcgggaggacgactctgacaagtactgcaaactgaacctacagcaatccggcagtttccagtactactttctgcagggcaatgagaagtccggcggcgggtacatcgtagtcgatccgattctgcgggtgggagccgacaaccacgtgctgcctctcgattgcgtgaccctgcaaaccttcttggccaagtgcctcggcccttttgatgagtgggagtcacggcttcgggtcgccaaggagagcggatacaatatgattcactttaccccacttcagactttgggcctgtctcggtcttgttattcgctggccaatcagctcgaactgaatcccgacttctcccgccccaacagaaagtacacttggaatgatgtaggacagctggtggagaagctgaagaaggagtggaatgttatttgcattaccgacgtggtgtacaatcataccgctgccaactctaaatggattcaggaacacccggagtgtgcctacaacctggtgaatagtcctcacctgaagccagcctgggtattggatcgagccctgtggcggttctcctgtgatgttgcggagggtaaatataaagaaaaagggatccctgccctgatagagaatgatcaccacatgaactcaattcggaagattatatgggaagacatcttcccaaagttaaaattgtgggagttcttccaggtggatgtgaacaaggccgtcgagcagtttaggcgtctccttacccaggaaaacaggcgagttaccaaatccgatccgaaccagcacctgacaatcatccaggacccagagtatcgtcgcttcggctgcacagtcgacatgaatatcgctttaaccaccttcatccctcacgataaaggccctgctgcaatcgaggaatgctgtaactggtttcataaacgtatggaggagctgaattctgagaagcaccggctaatcaattaccatcaggaacaggcagtcaactgtctgctcgggaacgttttctacgagaggctggcgggacatggacctaaactaggcccagtgactagaaagcaccccttagttacacgttacttcacttttccttttgaggaaattgattttagcatggaggaaagcatgattcacctgccaaataaagcatgcttcttaatggcccacaacggatgggttatgggggacgacccactgagaaactttgctgagccaggttctgaggtttacctcagacgcgaactgatatgttggggtgacagcgtcaagttacgctacggtaacaaacctgaagattgcccctacctttgggcccatatgaagaaatataccgagataacagctacgtactttcagggtgtgcgtctggacaattgtcattcaacgccgcttcacgtggccgagtacatgttggatgccgctagaaacctgcagccgaacctttatgtggtggctgagctgtttaccggatccgaggacctggacaacgtattcgtgacccgcctcggcattagttccttgattcgcgaggcaatgtccgcctataatagtcatgaggaaggccgactggtgtatcggtatggcggggagcctgtaggatcgttcgtacagccatgtttgagacccctaatgcctgctatcgcccacgctctgtttatggatattacacatgacaatgagtgccctatagtccacaggagcgcctacgatgccttgccctccacgactatcgtgtctatggcgtgttgtgcttcggggtccactcggggctacgacgagctggtgccccatcagatcagcgtagtttctgaagagagattctacaccaagtggaatcctgaggccttgccatctaatacaggcgaggtgaacttccagtccggcattattgccgctcgttgcgctatctcaaagttgcaccaggaactgggagctaaagggttcattcaggtgtatgttgaccaagtggatgaagatattgtcgccgttactcgacactcccccagcattcaccagagcgttgtcgcagtgagtcggacggcattcaggaacccgaaaacctctttttattctaaagaggtcccacagatgtgtatccccggaaagatcgaggaggtggttcttgaggctaggaccattgagcggaatactaagccctacagaaaggacgaaaacagcataaatggaactcccgacatcactgtggagattagagagcacatccagctgaatgaatcaaaaatcgttaagcaagcgggagtcgctaccaaggggcccaatgaatatatccaagagattgagttcgagaacctaagtcccggttccgttatcatttttcgagtgtcgctcgacccacacgcccaggttgcagtcggcattctcaggaatcacctgacacagttttctcctcattttaagtctggttctcttgcagtggataatgctgaccccatcctaaaaattccttttgccagcctcgcatcaagactgaccttagccgaattgaatcaaatcctgtaccggtgtgagagcgaggagaaggaagatgggggtgggtgttatgatattcccaactggagtgccctaaagtatgccggcctgcagggtctcatgagcgtgctagctgagatccggccgaaaaatgacctgggtcaccccttctgcaataacttgcgttcaggcgactggatgatagactatgtctcaaaccggttgattagtaggtccggaactattgcagaggtgggaaaatggctacaggctatgtttttctatctaaaacagatcccgagatatttgatcccgtgttatttcgacgccattctgattggagcctatacaacgctgctcgacacagcatggaaacaaatgagcagcttcgttcagaatggcagcacattcgtgaaacacctgtcactcgggtcggtacaattatgcggtgtaggaaaatttccttccctgcctatcctgagcccagcgctgatggacgtcccctaccgccttaacgagatcaccaaggaaaaggagcagtgttgtgtctcactggccgccgggcttccacatttctctagtggaatttttcggtgctggggacgagatacctttattgccctccgcgggattttactcataactggacgttacgtggaggctcgcaacatcattctggccttcgccggaacacttagacacgggctgattcccaatttgctcggcgaagggatctatgcccgatataattgccgggatgccgtgtggtggtggctgcagtgtatacaggactactgtaagatggtgcccaatggtcttgacatcctgaaatgtcccgtgtctcggatgtacccaacggacgattcggcccccctgccagctgggactctcgatcagcctctttttgaagtaatccaggaggccatgcagaaacatatgcagggaatacagtttcgggaacggaatgcaggtcctcaaatcgaccgcaacatgaaggacgagggattcaacatcactgccggagtcgacgaagagacaggattcgtctacggtggcaataggttcaactgcgggacatggatggacaaaatgggggaatctgatcgcgcacgcaacagaggcataccggcaacccctagggacgggagcgccgttgaaatagtgggtctgtcaaagtctgccgtgcgctggctgttagagcttagtaaaaagaacattttcccttatcacgaagtgaccgtgaagcgccatgggaaagctatcaaggtgagttatgatgagtggaatcgcaagattcaagataacttcgaaaaactgtttcacgtgagtgaagatccctccgacctgaacgagaaacatccaaacttggtgcataaaaggggaatttacaaggattcctacggggcctcttccccgtggtgcgattaccaactcagaccgaattttaccatcgccatggttgtcgcacctgaactcttcacaaccgagaaggcctggaaagctctggagatcgcggagaaaaagctgctcggccccttgggaatgaaaactctggacccagacgatatggtgtattgtggcatctatgacaatgcgctggacaacgacaattataatctggcgaagggcttcaattaccaccagggccctgaatggctttggccaatcgggtattttctaagggcaaaactatatttctcccgacttatgggacctgagaccaccgccaaaaccatcgtgttagtgaagaatgtgctgagtagacattatgtgcatctggagagaagcccttggaaagggttgcctgaattgacgaacgaaaacgcgcagtactgccccttcagctgcgagacgcaggcctggagtatcgctaccattttggagaccttatacgacctgtag

SEQ ID NO: 2330 - DNA, 4599 bp, Artificial Sequence
  Description of Artificial Sequence: Synthetic coding sequence
atggggcactctaagcaaatacgcatcctccttttgaatgaaatggaaaaactcgagaaaaccctattcaggctggaacagggctacgaacttcagttccgactaggtcccacgctccaaggaaaagcagtcaccgtctacacaaattacccctttccaggagagacattcaaccgggagaagtttcgtagcctggattgggagaatcccacagagcgagaggacgattctgataagtactgtaagcttaatctccagcaatccggatcttttcaatattactttctccagggaaacgagaaatccggcggaggttacatcgttgtggatcctatcctacgagttggagccgataatcatgtgctgccactggactgtgttaccctgcagacctttctcgcgaagtgtctgggcccttttgatgaatgggaatcacgcctcagagttgctaaggagtctggctataatatgattcacttcacacctcttcagacactgggattgagtcgatcatgctactctctcgccaaccagctggagctgaatccagacttctcacgacctaaccgaaagtatacatggaatgatgtggggcagttggtagaaaagttgaagaaagagtggaatgtgatctgtattaccgacgtcgtttataaccacactgcagctaattcaaaatggatccaagaacaccctgaatgtgcgtacaacctggtgaactctcctcacttaaaacctgcttgggtgctggaccgcgcgctttggcgcttctcctgcgacgtggccgaaggcaaatacaaggaaaagggcattcccgctctaatcgagaacgaccaccacatgaactccataagaaaaattatctgggaggacatctttccaaagctgaagctctgggagttcttccaagttgacgtgaacaaggcggtggaacaattccggcgactccttactcaggaaaatcgcagagtgacaaagtcagaccccaaccaacatttgactataatccaagatcccgaatatcggcggttcgggtgtactgtcgatatgaatatcgccctgacaacatttatcccccatgacaaggggccagcggctatagaagagtgctgcaactggttccataaaaggatggaagagcttaacagtgaaaagcacaggcttattaactatcaccaagagcaagccgtcaactgcttattaggcaatgtgttctacgagaggctggctggccacggccccaagctaggaccagtgactcgcaagcacccactggtgacaagatacttcactttcccattcgaggagatcgacttctctatggaagagtccatgatacatctgccaaacaaggcctgcttcctgatggcccacaacggttgggttatgggagatgaccctttaaggaacttcgctgaacctgggagcgaggtgtatctccggcgtgagttgatctgttggggggattcagttaagctccgatacggcaataagcccgaagattgcccatatttgtgggcccacatgaaaaaatataccgagataacagccacctatttccagggggtccggttggacaactgccatagtactccccttcacgtcgctgagtacatgctcgacgccgccagaaatctgcagccaaacctgtacgtggtggcagaactgtttacagggtcagaagatctcgacaatgtctttgtcactaggctgggcatttcttccttaatacgtgaggcaatgagtgcatacaacagtcacgaagaaggccgtttagtgtaccggtacggcggcgaacctgtggggtccttcgttcagccatgtctacggccactgatgcccgctatcgcccatgccctgttcatggatatcacacacgacaatgagtgcccaatcgtccacagaagtgcttatgacgcattaccaagcacaaccatcgtctccatggcctgctgcgctagcgggagcactagagggtacgacgaactggtaccacatcagatctcagtcgtcagcgaagagcggttctatacgaaatggaaccccgaggccttgccttcaaacacaggggaagtcaacttccagtcgggaatcattgctgccagatgcgctatctccaagttgcaccaagagctgggggccaaaggcttcatacaagtctatgtcgaccaggtggatgaagatattgtggccgtcactagacactctccctcaatccaccaatctgtcgtggcagtgtcaaggacagctttccgcaacccaaaaacttccttttacagcaaggaggtaccccagatgtgcatccccgggaagatcgaagaggttgtcttagaggcccgcacgattgagcgcaacactaaaccgtatagaaaggatgaaaacagcatcaacggtactccggatatcaccgtggagatccgcgaacatatccagctcaacgagagtaagatagttaagcaggccggagtggcaacaaagggacctaacgaatacatccaggagatcgagttcgaaaacctgagtcccggctctgtgatcatctttcgagtgtctctcgatcctcatgcccaggtggcggtggggatacttcggaaccacctcacacagttttcaccacacttcaaaagcggcagcctcgcggtagataatgccgacccgattttgaagatacctttcgctagcctggcttctcgactgactttggccgagctcaaccagatcctctaccgatgcgaatctgaagagaaggaggatgggggtggctgctatgacatccctaactggagtgctttgaagtacgctgggttgcaagggctgatgtctgtgttggcggagatccgtcctaaaaatgatctggggcacccattctgtaacaaccttcggtcaggtgattggatgattgactacgtcagcaatcggcttatttcccggtctgggacaatagcagaagttggaaagtggctgcaggccatgttcttctacctcaagcagatcccccgctacctcatcccatgctacttcgacgccatcctcatcggtgcctatacaacactattggacactgcctggaaacaaatgtcatccttcgttcagaatgggtccacctttgtcaagcatttgtccttgggaagtgtccagctgtgcggcgtgggcaagtttcctagtctgccgattctgagtcccgctctcatggacgttccctaccggctgaacgagattacaaaggaaaaagagcagtgttgcgtctcgttggcggccggactgccgcacttctcaagcgggatcttccggtgctggggacgggataccttcatagcattgcgaggcattctgttgattactggtcggtacgtcgaagcaaggaatataatcctggcttttgctggcaccctgcgccacggcctgattcctaatctgcttggggagggtatatacgcccgctacaactgccgtgacgctgtctggtggtggctccagtgcatccaagactattgcaagatggtgccaaatggtctagacattcttaaatgccccgttagccggatgtacccaacagacgactctgcccctcttccagccggaaccctggaccagccactcttcgaggttatccaggaggccatgcagaaacacatgcaagggattcagtttcgagagcgcaatgccggcccccagatcgacaggaacatgaaagacgagggattcaacatcactgccggagtagatgaagaaacaggattcgtctatggaggcaaccgcttcaactgcggcacgtggatggataagatgggggaaagcgaccgagcacggaatcggggtattcccgccaccccccgagacggcagcgcagtggagatagtcggcctgagcaagagcgcagtccgctggctccttgaattatccaaaaaaaacattttcccttatcatgaggtgaccgtaaagcgtcatggtaaagccataaaggtgagctacgacgagtggaatagaaagatccaggacaattttgagaaactgtttcatgtaagtgaggaccccagcgatctcaacgaaaaacatccaaatctagtacataagcgcgggatctataaagactcttatggcgcatctagcccctggtgcgattatcagctgcgacccaactttaccattgcaatggtggtagccccagagctctttacaacagaaaaagcctggaaagcactcgaaatcgccgagaaaaagctgttgggacctcttggaatgaagaccttggatcccgacgatatggtatattgtggcatttatgacaatgccctggacaatgacaattataacttagcgaaaggtttcaattaccaccaaggcccagaatggctgtggcctatcgggtattttcttcgtgctaaattgtatttcagtaggttgatgggccctgagaccaccgccaaaaccatagtactggtgaaaaacgtcctgagtcgtcattacgtgcacttagagcgttctccctggaaggggcttcctgagcttacgaacgagaacgcacaatattgccctttctcttgcgagactcaagcatggagtatagcgaccatactggagactctttatgatttatag

SEQ ID NO: 2331 - DNA, 4551 bp, Artificial Sequence
  Description of Artificial Sequence: Synthetic coding sequence
atggctccgatcctgagcattaatctgttcatcggctacgagcttcagtttcggcttggcccaacattgcagggtaaggcagtgaccgtgtacaccaactatccattccccggggagacatttaatcgtgaaaagttccggtccctcgattgggagaatcccactgagcgtgaagacgattcagacaaatactgcaagctcaatttgcaacagtcagggagcttccagtattattttctccaaggcaacgaaaagtctggaggggggtatattgtagttgatccaatcctgcgcgtgggtgcagacaaccatgtgctgcccttggactgtgtcacactccagacttttcttgcaaaatgtctcggaccgtttgatgaatgggaatcccgccttagagtggccaaagagtccggctacaatatgatccattttacccctctgcagaccctgggtctgtctcgttcctgctacagcctggccaatcagctggagttgaaccccgacttctctcgcccgaacagaaaatatacgtggaacgacgtcggccagctggtggaaaaattaaagaaagaatggaacgtaatttgtattactgatgtggtctacaaccacaccgccgcgaattccaaatggattcaggagcaccctgagtgtgcttacaacttggtcaattcccctcacttgaagccggcttgggtgctggacagggctttatggaggttcagctgcgacgtggctgagggaaagtataaagagaaagggattcctgcacttatcgagaatgatcaccacatgaattctatccgtaaaataatatgggaagatatattcccaaagctaaagctatgggagtttttccaagtggacgtaaacaaggcggtggagcagttcagacggctgttgacgcaggagaaccgcagggtgacaaagtccgaccccaaccaacacttgacaattattcaggacccggaatatcgtaggtttgggtgtaccgtcgatatgaacatcgcacttacgaccttcatcccacatgataagggtcctgcagccattgaagaatgctgcaactggttccataaaaggatggaagaactgaactccgaaaaacatagactcatcaattaccatcaggaacaggctgttaactgtcttttgggcaacgtgttttatgagagactggcgggtcacggacccaaactgggccccgtgacgcggaagcatccactggtcactaggtattttaccttcccttttgaggagatcgacttctctatggaagagtcaatgatccaccttcctaacaaagcctgctttctgatggcacacaacggatgggtaatgggagatgaccctctgcggaattttgctgagcccggtagcgaagtctacctcagacgggaactgatctgttggggggacagtgtgaagctcaggtacggcaataaaccagaagactgtccttatttgtgggcacacatgaaaaaatacacagaaataaccgctacatactttcaaggtgtaaggctagacaattgtcattctaccccactccacgtagcagagtatatgctggatgcggcgcgcaacctgcaaccaaatctatatgtggttgctgagttgttcacgggctccgaagatctggacaacgtatttgttacacgtttgggaatcagttccctcattagagaggctatgagcgcatacaacagtcatgaagaaggccggcttgtgtaccgctacggaggggagcctgtgggcagttttgtccaaccctgcttaagaccactgatgccagccatcgcgcacgccttatttatggacattactcatgacaatgagtgcccaattgtgcaccgaagtgcctacgatgccctgccttccacaaccatcgtctcgatggcttgttgtgcaagtggctccaccagaggatacgatgaattggtgccacaccaaatctctgtcgtctccgaagaacgcttctacaccaaatggaatccggaggctctgcccagtaataccggggaggtgaatttccaatctggcataattgccgcccgttgcgcaatcagtaaattgcaccaggagctgggggctaagggcttcattcaggtgtatgtcgaccaggtagacgaggatatcgtggcggtgactagacactccccttctattcatcagagcgtggtcgctgtgtcgagaactgcattccgtaaccccaaaacctctttttattctaaagaagtgccccagatgtgtatcccaggaaagatcgaggaggtcgtgctggaagcccggaccatcgaacgcaataccaaaccttataggaaggacgaaaattctatcaacggcacccccgatataactgtggaaatccgtgaacatatccaacttaacgagtctaagatcgtgaaacaggccggtgtagcaaccaaaggacctaacgagtacatacaggaaattgagtttgagaacctatcacctggcagcgtcattatttttcgggtgtcactggaccctcatgctcaggttgcagtgggcatcctaagaaatcacttaacccagttctctccgcactttaagtcgggcagtttggctgtggacaatgcagatcctatcttaaagattccctttgccagcttagcttcaagactgactttagcagaactgaatcaaatcctgtatcgctgtgagtccgaggagaaggaggacggaggtggctgttacgatatcccgaattggtccgcccttaaatatgctggcctccagggccttatgtctgtgctggccgagatcaggcctaaaaacgacctaggacaccctttttgtaacaacctcaggtctggcgattggatgattgattatgtgtcaaataggctgatcagtagaagcggcaccatagctgaagtgggcaagtggctgcaggccatgttcttttacctaaagcagattccccggtatttgatcccttgttatttcgatgccatcctcattggggcctacaccacactgctggacacggcgtggaagcagatgagcagtttcgtccagaacggaagcacatttgtcaaacacctgagcctgggttcagtgcaactatgcggcgtgggaaagttccccagcctgcctattctctctccagcccttatggacgtgccatacagattgaatgaaattacaaaggagaaagaacaatgctgcgtgagtcttgccgctggtctcccacatttctctagcggtatctttcgttgctggggcagagacacctttatcgctctgaggggaatcttactcatcacgggccggtatgttgaggcaaggaacatcattctagcctttgcagggacactgcgacatggtctgattcccaacctgcttggggaagggatatatgctagatacaactgccgggatgccgtgtggtggtggcttcagtgcatccaggattactgcaaaatggtgcccaacggcctcgacattttaaaatgcccagtctccagaatgtacccaaccgacgactctgcccctctgcccgctggcacactggaccagccgctattcgaagtcatacaggaggctatgcagaagcacatgcaagggatccaatttcgggaacgcaacgccggtcctcagatagataggaacatgaaggatgaggggttcaacataaccgctggtgtggacgaagagacaggcttcgtttatgggggaaaccgctttaactgcggcacctggatggacaaaatgggtgaatccgaccgtgcacgaaatagaggaattcctgcgacgccgcgcgatggtagtgccgttgagatagtggggctgagtaaatcagccgttaggtggctcttagagctttcaaagaaaaatatttttccgtatcacgaagtgacagtgaaacgccatggcaaggcaatcaaggtctcttacgacgagtggaacagaaagatccaagacaattttgaaaaactttttcatgtgtccgaggatcccagcgacctgaatgaaaaacatcccaatctagtgcacaagcgggggatctataaggatagctacggtgcatctagtccctggtgcgactatcaattgcgcccgaactttaccatcgccatggtggtcgcccctgagctgtttactaccgagaaagcctggaaggcactcgagatcgcagagaagaaattgctgggcccgctgggcatgaagacactcgaccctgacgacatggtgtattgcggtatttacgataacgctctggataatgataattacaatctggccaaggggttcaattaccaccaggggcctgaatggttgtggcctatcgggtatttcctgcgggctaagttgtactttagtcgtttaatggggccagaaaccaccgcaaagacgatcgtgctggtgaagaatgtgctttcaagacactacgtgcacttggagaggtcaccttggaaaggcctgcctgagttgactaacgaaaatgctcagtattgccccttcagctgcgaaacacaggcctggagcatcgctacaatcctggagaccctctacgatctgtag

SEQ ID NO: 2332 - DNA, 4599 bp, Artificial Sequence
  Description of Artificial Sequence: Synthetic coding sequence
atgggtcacagcaagcagatcagaatcctcttactcaatgaaatggagaaattggagaagaccttattccgcttggaacagggatacgagctgcagtttaggttgggaccgacccttcagggcaaggcagtgaccgtttacactaattacccttttcctggggagacctttaatagagaaaaattccggagtttggattgggaaaatccaacagagcgcgaagacgattcagacaagtattgtaagctgaacctgcagcaatccggatcctttcagtactatttccttcaaggtaacgagaagagtgggggcggctatattgttgtagatccaatcctgagagtcggagccgataatcatgtgttaccactagactgtgtgacattgcagactttcttagctaaatgtctgggcccctttgatgaatgggaaagccggttgagggtagccaaggagtccggctacaatatgatacacttcacaccccttcaaaccctgggcctgagcaggtcttgttattctctggccaaccaactggaactgaacccggacttctctcgtccaaacagaaagtacacatggaacgatgtcgggcagctggtcgagaagctgaagaaagagtggaacgtgatatgtattaccgatgtggtgtacaaccacactgcggcaaattccaagtggatacaggaacaccccgagtgtgcctataaccttgtcaacagcccacatctcaaaccggcctgggtgctggatcgcgcactctggcgttttagctgcgacgtagccgagggcaagtacaaggaaaaggggatcccggctctgatcgaaaatgaccatcatatgaattccatccgtaaaatcatctgggaggacatctttccgaaactgaaactatgggaatttttccaggttgatgtgaataaagctgtggaacaattccgccgcctgctaacccaggaaaataggcgggtgactaagtctgaccccaatcagcatctgactattattcaggatccagagtataggagattcggttgtacagtagacatgaacatcgcacttactacctttatcccccacgataaggggcccgccgctatcgaggaatgttgtaactggtttcacaagaggatggaagagctgaatagcgagaaacaccgcctaatcaattaccatcaggaacaggcagtgaattgcctcctgggaaacgtgttctatgagagactagcaggccatggaccaaaattaggccctgttacgcggaaacatcccctggtgacgcgctattttaccttccccttcgaagagattgatttcagcatggaggaatccatgatccatttgccgaacaaggcctgttttctaatggcacataatggttgggtcatgggcgacgatcccttgaggaacttcgcagaacccgggagcgaggtttatttgaggagagaacttatctgttggggcgattcggtgaagttgcggtatggcaataaaccagaagactgcccgtacctctgggcgcatatgaagaagtacacagaaattacagctacctatttccaaggagtcagactcgataactgccactccacacccctgcatgttgctgaatacatgctggatgcggctcgtaatctacagcccaacctgtacgtggtcgccgaactgtttaccggatccgaggatctggataacgtttttgttacccgcctaggaatttcatctctgataagggaagcaatgtccgcctataatagccacgaggaaggaagactcgtgtatcgttacggaggtgagccagtcggctctttcgttcagccatgtctgaggccgctcatgcctgcaattgcccacgccctgttcatggatatcactcacgacaacgaatgtccgatcgtgcaccgttccgcttatgatgctctgccatctacaacgatcgtgtccatggcctgctgcgcaagtggttcgacccggggatatgatgagctggtgccccaccagatttctgtggtgtcggaggaacgcttctacaccaagtggaaccccgaggccctgccgagcaataccggcgaggtgaactttcaaagcggcattatagctgcccgttgtgcaatcagcaagttgcaccaggaactgggggctaagggattcattcaagtctacgttgaccaggtggacgaggatatcgttgctgtgacacgccactcgccttccatccaccagtctgtggttgccgtctctaggactgcttttcggaacccgaaaacgtccttctattcgaaggaagtcccacagatgtgcattcccgggaagattgaagaggtagtgttggaagcaaggactatagagcgtaacaccaagccttatcggaaggacgaaaactctattaatggcactccagatataaccgtagagatccgggagcacatccagctgaacgaaagtaaaatcgtgaagcaagccggggtggccaccaaggggcctaatgagtatatccaggagattgaatttgaaaacctgagtccagggagcgtcatcatttttcgagtgagcctcgatccccacgctcaggtcgctgtcgggatacttaggaatcatcttactcagttttccccacatttcaagtccggcagcctggcagtggataacgctgatcctatattaaaaattcccttcgcatccctagcatcacgccttacgctggccgagctgaaccagatactgtatagatgtgagagcgaagaaaaggaggatggtggcggctgctatgatattccgaattggtctgccctgaagtatgccggtttgcaaggtctgatgagcgtcttagccgaaatcaggccaaagaacgacctgggacaccctttctgcaacaacctccgctccggtgactggatgatagactatgtgagcaaccgattgatttcgcgaagcggaacaatcgctgaggttgggaaatggctgcaggccatgttcttctatttgaaacaaattcccaggtacttaattccatgttactttgacgccatacttattggcgcttacaccaccctcctggatactgcctggaaacaaatgagcagctttgtgcagaatggttcaacatttgtgaaacatttatccttgggttcagttcagctttgcggcgtcggcaagtttccaagtcttcctatcctgtctcccgctctgatggacgtcccatatcggcttaacgaaattacgaaggaaaaggagcagtgctgcgtgagcttagcagcagggctcccacacttctccagcggaatcttccggtgttggggccgcgacacatttatcgctctgcgtggtatacttctgataaccggacgctatgtggaggcgaggaacatcatcctggcatttgctggtacccttagacacggcctcattcctaacttactcggtgaggggatctatgcacggtacaactgtagagacgctgtctggtggtggctgcagtgtatccaagattattgcaaaatggtgcccaacggcttggacattctcaaatgccccgtgtccaggatgtatccgactgacgacagtgcaccactgcccgctgggaccctcgaccagccgttattcgaggtgatccaggaggcaatgcaaaagcacatgcagggtattcagtttagagagagaaacgccggacctcagatcgacagaaatatgaaagatgaagggtttaatataactgctggggtggacgaagaaactggctttgtatacggaggcaatagatttaattgcgggacatggatggacaaaatgggagaatcagaccgcgcacggaatagggggatccccgccactccaagagatggtagtgcagtggagattgtaggcctgtctaaaagcgccgtgcgctggctgctggagttgtctaagaagaatatctttccataccacgaggtgaccgtcaagagacatggcaaggcaataaaagtttcctacgatgagtggaacaggaaaattcaggacaattttgaaaaattattccacgtctcagaagatccgagcgatttgaatgaaaaacacccgaacttggttcataagaggggcatttataaagatagttacggcgcatcctccccatggtgcgactatcagttgagacctaacttcacgattgctatggtagttgcacctgagctcttcaccaccgagaaggcctggaaggctctggagattgctgaaaagaagctccttggccctctgggcatgaaaactctggaccctgatgatatggtgtactgcgggatctatgacaacgccttggacaacgacaactacaatctggccaagggcttcaattaccatcaaggcccagaatggctgtggcctataggttattttttacgtgccaagttgtacttcagtcgactcatgggaccagaaaccacggcaaagaccatagttctggtcaaaaacgtgcttagtagacactacgtgcatctggaacggagtccatggaaaggcctccctgaactaacaaatgaaaacgcccaatactgccctttcagttgcgagacacaagcatggtcaatcgccacgatccttgagaccctgtatgacttgtag

SEQ ID NO: 2333 - DNA, 4599 bp, Artificial Sequence
  Description of Artificial Sequence: Synthetic coding sequence
atgggacatagcaagcagatacgcatcttgttactgaatgagatggagaaattagagaagactctttttaggctagagcagggatacgagctacagttccgcctgggcccgactctgcagggcaaggccgtgacggtttacactaactacccctttccaggtgaaacatttaacagggaaaagttcaggagcctggactgggagaaccccacagaaagggaggatgacagcgataaatactgcaagttaaacttgcagcagtctggatctttccagtactattttctgcaaggcaacgagaagagcgggggaggatacattgtcgttgatcctattctgcgggtgggagctgacaaccacgtgttacccctggactgcgttacccttcagaccttcctggctaaatgtctcgggcctttcgatgagtgggagagccgcttacgggttgcaaaagaaagcggctataacatgattcacttcaccccgctccagaccctaggtttgtctaggtcatgctattccctggcgaaccagctcgaactcaaccctgatttttcccgcccaaatcgaaaatatacctggaacgacgtcgggcagctagtggagaaactcaagaaggaatggaacgtgatatgtattaccgacgtggtctacaaccacacagctgccaacagtaaatggatccaggaacaccccgagtgtgcctacaacctggtcaattccccacatctcaaaccggcctgggttcttgatcgggctctttggcgatttagttgcgatgtcgctgaaggaaagtataaagaaaaggggatacctgccctcatcgaaaatgatcaccatatgaatagtataagaaagatcatctgggaggatatcttcccaaagcttaaactttgggagttctttcaggtagacgtaaataaggccgtcgaacagtttaggcgcctgcttacccaggagaaccgccgcgtgacaaaatccgatcccaaccagcatctgaccattatccaagatccagaatatagacggtttggttgcaccgtggatatgaatattgcactgacaaccttcattccccacgacaaaggccctgccgcaattgaagagtgttgtaactggtttcacaagcggatggaggagctgaactctgagaagcatcgactcattaactaccaccaggaacaggctgtgaattgcctcctaggaaacgtcttctacgaacggctggccggccatggccctaagctggggcccgttacgcgtaaacatcctttggtgacgcggtacttcactttcccttttgaggaaatcgatttctcgatggaggagtccatgatacacttgcctaacaaagcctgcttcttgatggctcacaacggctgggttatgggcgatgacccactgcggaattttgcggaaccaggaagcgaggtctacctgcgcagagagctcatatgttggggtgactctgtcaagcttcggtacgggaacaagcctgaagattgcccttacctgtgggcccacatgaagaagtatacagagattaccgctacatatttccagggagtgcggctcgataattgccattcaacccctctacacgtggcagaatatatgttagatgccgcacgcaatctgcagcccaatttatacgtagtggccgaacttttcactggatctgaggacttggacaatgtctttgtcactcggctcgggattagctcgcttatcagggaggccatgtcagcttacaattcacacgaagagggccgccttgtttataggtacggcggagagcccgtgggctccttcgtgcagccttgcttacgtcccctgatgcccgccattgctcacgccctgttcatggacatcactcatgataacgaatgcccgatcgtccacagaagcgcttatgacgccctgccatcaaccactatcgtgagcatggcttgctgtgcatccgggtcgactagaggctatgatgaactcgtgccccaccagataagcgtcgttagtgaggagaggttctacaccaagtggaaccccgaggcccttcccagcaataccggcgaggtgaacttccagagcggcattatcgccgctcggtgtgcaatctctaagctgcatcaggagctgggcgccaagggcttcatccaggtttatgtggaccaggtggatgaagatatagtggcagtgacaaggcactcacctagtatccatcagtcagtcgtggccgtgagtagaacagcttttagaaaccccaagacaagtttttactccaaagaagtgccgcagatgtgtatccccgggaaaatcgaagaagttgttctagaggctcgcactattgaaaggaacacaaaaccctaccgaaaggacgagaattccattaacggaactcccgacatcaccgtggagatccgcgagcacattcagctcaacgaatctaaaatcgttaaacaagcgggggtcgccaccaagggtccaaatgaatatattcaagaaatcgagtttgagaacctgtcgccaggctcagtgatcattttcagagtttcactggatccgcacgcacaggtcgcagtcggaatcttgagaaaccaccttacacagttctccccgcactttaaaagcgggtctctggcggtagataatgcagatcccattctcaaaattccattcgcctctctcgctagccggttgaccttagctgagctcaatcagatcctctatcgctgcgagagcgaggaaaaggaggacggcggaggatgctacgatatacccaattggtcagccctgaagtatgccgggctgcagggactgatgtcggttctcgcggagatacggccaaagaatgacctgggacaccccttctgcaataacctgcgttctggagattggatgatcgactacgtatctaaccgcctgatttcacggtcaggaacaatagcggaagttggaaagtggctgcaggctatgttcttttatttgaaacagataccacgctatctaatcccttgttacttcgatgctattctaatcggcgcctacactacactgcttgacaccgcctggaagcagatgtcatctttcgttcaaaacgggagcaccttcgtgaagcaccttagtctgggatccgttcaactttgcggggtcgggaaattcccttcactccccatattaagccccgccctgatggatgtgccctatagactgaacgaaattacaaaggagaaagagcagtgctgcgtgtctctggcagccggccttccacattttagctcaggaatatttcgatgctggggccgggacacatttatcgcattacgcggaatactcctaatcacaggacgatacgtcgaggccaggaatattatcctggcctttgctggtactctccggcacggcctgatccctaacctgttaggcgaaggcatctatgccaggtataattgtcgcgatgcggtgtggtggtggctgcagtgcattcaagactactgtaaaatggtcccgaatgggctggatatccttaagtgccccgtgtcacgcatgtatccaacggacgacagcgctcccttacctgctggcactctggatcagccactgtttgaagtgattcaggaagccatgcagaagcatatgcagggcattcagttccgagaacgcaacgccggccctcaaatcgatagaaatatgaaagatgaaggttttaatattaccgctggagtagacgaggagacagggtttgtgtacggaggcaatcggtttaattgcggaacctggatggacaaaatgggggaatccgatagagccagaaatcgtggcatccctgcgaccccacgcgacggtagtgcagtcgaaatcgtaggtctttccaagagcgcagtgcggtggttgctcgaactctccaagaagaacatctttccttaccacgaagtgactgtgaagcgtcacggaaaggccattaaagtaagctacgatgaatggaacagaaagattcaggacaattttgaaaagttattccatgtgagcgaggacccctctgatttaaatgaaaagcatcccaacctagtccacaaaaggggcatctacaaagatagttacggggcttcatccccttggtgtgactatcaactgcggcctaactttactattgctatggtggtggcccctgagctgttcaccacagaaaaagcatggaaagctctggagatagctgaaaaaaagctgctggggccactcggcatgaaaactctggaccccgatgatatggtgtactgtggaatttatgacaacgcgctggacaacgataactataaccttgccaagggcttcaattatcatcagggcccggagtggctatggcctataggatacttcttgcgggctaaactctacttttctagattaatgggccctgaaacaacagccaagaccatcgtgctggtgaagaacgttctgagtaggcactacgtccacctagagcgttccccctggaaagggctaccagaactgactaatgagaatgcccagtattgtccattcagctgtgagacgcaggcgtggtcaatagccacaatactagaaaccctgtatgatctctag

SEQ ID NO: 2334 - DNA, 672 bp, Artificial Sequence
  Description of Artificial Sequence: Synthetic coding sequence
atgaataagcccctgctgtggatcagcgtgctgacaagccttctcgaagcgttcgctcacaccgacctctcaggtaaggtgtttgtttttccccgtgagtctgtgaccgatcatgttaaccttatcaccccactggaaaagccgcttcaaaatttcactctttgtttcagagcgtattctgaccttagtcgcgcatacagcctgttcagctacaacacacagggacgagataacgaacttctggtctacaaagagcgtgtcggtgagtactctctttacattgggcggcacaaagtaacttcaaaggtgatcgagaagttccccgccccagtccatatctgcgtgtcgtgggagagcagtagcgggatcgcagaattttggattaacggtactccccttgttaagaaaggactgcgccagggttactttgttgaggcccagccaaaaatcgtgctggggcaggaacaagactcttatggcggaaaattcgatcgatcacagtcattcgtgggtgagatcggggacctctatatgtgggatagtgttctcccccccgagaatattttgtccgcgtaccaaggtactccgctccccgctaacatactggattggcaggccctaaactacgagattagaggatatgtgattattaagccccttgtctgggtttag

SEQ ID NO: 2335 - DNA, 2418 bp, Artificial Sequence
  Description of Artificial Sequence: Synthetic coding sequence
atgagttcttccagttggctcctgttgtccctcgttgcagttactgccgcccagagcacaatagaagaacaggcaaaaacttttctggacaaattcaatcacgaagccgaagacctcttttatcagagttcactggcaagttggaactacaacaccaatattactgaggaaaacgtgcagaacatgaacaatgcgggggataagtggtccgcctttttgaaggagcagtcaactctggcacagatgtacccattacaggaaattcagaacctgacagttaagctccagctacaggcgttacagcaaaatgggtcaagcgtcctgtcagaggacaagtctaaaagattgaacaccatcctcaatacgatgagtactatctactcaactggtaaagtgtgtaacccagataacccacaggaatgcctcttgctggagcccggcctgaacgaaataatggctaatagcctggactacaatgaaagactgtgggcatgggaatcatggcgcagcgaagtgggtaaacagcttagaccactttacgaggaatacgtggtccttaagaatgagatggctcgcgccaatcactatgaggattatggtgattattggcgcggagattatgaggttaatggcgtggacggctatgactactcaaggggtcagcttattgaggacgtagagcataccttcgaagagataaagcctttgtacgagcatttgcacgcctatgtacgggcaaaattgatgaacgcctacccatcctacatatccccgatcggatgcctgcctgcgcacctgttgggcgatatgtgggggcggttttggaccaacttatactccctgacggttccttttggtcaaaagcctaacatcgacgttacggatgcgatggtggatcaggcttgggacgcccagaggattttcaaagaggcagagaagttttttgtgagcgtagggttgcccaatatgactcagggcttttgggaaaactcgatgctaaccgacccgggtaacgtacaaaaggctgtgtgtcaccccacagcctgggacttggggaaaggagattttaggattctgatgtgcacaaaggtgacaatggacgatttcctgaccgcccatcacgaaatgggacacatccagtacgatatggcctacgccgcccaaccattcctgctgcggaacggcgcaaatgaaggctttcacgaagccgtgggcgaaatcatgagcctctctgccgccacccctaagcatctgaaaagcatcggtttactgtcccctgactttcaagaggataatgaaaccgagataaattttctgctcaagcaggctttaactatcgtcgggactttaccatttacctacatgttggaaaagtggaggtggatggtttttaaaggggagattccaaaagaccagtggatgaagaaatggtgggaaatgaagcgggaaatcgtgggtgtggtcgagcccgtacctcacgacgagacgtactgtgatcccgcctctctgtttcacgtcagcaacgactattcattcatccggtattatactagaacgctttatcagttccaatttcaggaggccttatgccaggctgccaagcacgaaggaccgctacataaatgcgacatctccaattcaacggaggcaggacagaaattgtttaacatgctgcgcttgggtaagagcgagccttggaccctggccctggagaatgtggttggcgctaagaacatgaatgtcagacccctgctcaattacttcgagcccttgttcacttggctcaaggaccagaacaagaatagcttcgtgggatggtccactgactggtcaccttacgccgatcaaagtattaaggtgcgcattagcctcaagagtgcgctcggggacaaagcgtatgagtggaatgataatgagatgtacctgtttcgctcaagtgtggcctacgccatgaggcagtattttctcaaggttaagaaccaaatgatcctgttcggcgaagaggatgtccgagttgcgaacctgaaaccacgaatctcttttaacttcttcgtcaccgctccaaaaaatgtatccgatataatacccagaacggaagtggagaaagccatcagaatgtcacgatcccgcattaatgacgcttttaggctgaacgataattccttagaatttctcggcatacagcctacgctgggccccccaaaccagccgccagtgtcaatctggcttatagtgtttggcgttgtcatgggcgtgatcgtcgtaggcattgtgatccttattttcacaggaatacgggatagaaaaaagaagaacaaggcccgaagcggcgaaaacccttatgccagtatcgacatcagcaaaggggagaacaacccgggcttccagaatactgatgacgtgcagactagtttctag

SEQ ID NO: 2336 - DNA, 2418 bp, Artificial Sequence
  Description of Artificial Sequence: Synthetic coding sequence
atgtcatccagtagttggctgctgttatccctagtggcggtgactgccgcccaaagtacgatagaagaacaagctaaaacatttcttgacaagtttaaccacgaggcggaagatctcttctatcagtcatccctggctagctggaactataacactaacattaccgaggaaaacgtccagaacatgaataacgcgggtgataaatggtccgcattcctgaaggagcagtcaacccttgcacagatgtatccacttcaagagatccagaaccttactgtgaagctgcagcttcaggccctgcagcagaatggatccagcgttctgtcagaagacaagagcaaacgtctgaatactattctgaatacaatgtctaccatctattcaaccggaaaagtctgcaatcccgataacccacaggaatgtttgcttctggagcctggccttaatgagataatggccaattcactggactacaacgaacgactatgggcgtgggagtcttggaggtctgaagtgggaaagcaactccggccgctttatgaagaatacgtcgtcctaaagaacgaaatggctagggccaatcattatgaggactacggagactattggcgtggagactatgaggttaatggggtcgacggctacgattactctcgtggccagctgatcgaagatgtggagcatacctttgaggagattaagcctttgtatgaacatctgcatgcctatgtcagagctaagcttatgaatgcgtatccctcctacatttcacctatagggtgtcttcccgctcatctgttaggtgacatgtggggtcgtttttggacaaatctgtactccttgacagtgcctttcggtcagaaacccaacatcgacgtgactgatgccatggtggaccaggcatgggatgcccagagaatttttaaggaggccgaaaaattcttcgtgtctgtaggcctgcctaatatgacccagggtttctgggaaaattccatgctgactgatcccgggaatgtgcagaaagccgtctgccaccccactgcttgggatctgggaaagggcgactttcggatcctaatgtgtaccaaagttactatggacgattttctcaccgcgcaccacgaaatgggccatatccagtacgatatggcatacgcagcccagcctttcctgctgaggaacggggcaaatgaaggctttcacgaggccgtgggggaaattatgagcctgtcggcagcaacccccaagcacctgaagtcaattggattgttatcacccgacttccaggaggataatgagaccgagataaattttctcctcaagcaggctctgactatcgtggggaccctgccgttcacctatatgctcgaaaaatggaggtggatggtgtttaagggcgagattcccaaggatcaatggatgaagaaatggtgggaaatgaagcgcgagatcgtgggagtagtggaacccgtaccccatgatgagacatactgtgacccagcctcgctattccacgtgagcaatgactatagcttcatcaggtattacacgaggacgctgtaccagttccagtttcaagaagctctgtgtcaggccgcaaagcatgaagggccattacacaaatgtgacattagtaacagtacggaggctggtcagaaactatttaacatgttgagactgggaaagagcgaaccatggacattggccctagagaatgtggtgggggccaagaatatgaacgtaagaccactgctcaactactttgaaccactattcacttggctcaaggatcagaataagaattcatttgtggggtggagtaccgattggagtccatacgctgaccagtcaatcaaagtccggatatcgctaaagtctgctctgggagacaaggcctatgaatggaacgacaacgagatgtaccttttcaggagctcagtcgcatatgcaatgaggcagtacttcctcaaggtcaagaaccagatgattcttttcggagaggaagatgtgagagtcgctaaccttaagccccgaataagtttcaatttttttgtgaccgcacccaaaaatgtctccgacatcataccccgaactgaggtcgaaaaagctatccggatgagtcgctccagaatcaacgacgctttcagactgaatgacaatagcctagaatttctcgggattcagccaaccctgggccctcctaatcaaccccccgtctcaatttggctgatcgtgtttggtgttgtaatgggagtgatagtggtggggattgtgatacttatttttactggcataagggataggaagaaaaagaataaggcaagaagtggggagaacccctacgcgtcaattgatatcagcaagggcgagaataacccggggttccaaaacacggatgatgtgcaaactagcttctag

SEQ ID NO: 2337 - DNA, 804 bp, Artificial Sequence
  Description of Artificial Sequence: Synthetic coding sequence
atgaaggccgccgttttaactttggccgtgcttttcctgacgggtagtcaggccagacatttttggcaacaggacgagcccccccagtcaccatgggatagggtgaaagatttagctactgtgtacgtcgatgtgttgaaggacagcggacgcgattatgtttcccagtttgaaggatccgcattggggaagcagctgaacttgaagctacttgacaattgggactcagtgacttcaaccttttcaaagctccgggaacagctcggccccgtgacgcaagaattttgggacaacctcgaaaaggaaactgaggggttacgccaggagatgagcaaggacctggaagaggttaaagcaaaagtgcagccatacctcgacgatttccaaaaaaagtggcaagaggagatggagctgtatagacagaaagttgagccattgagagctgagctccaggaaggcgcacgccagaaactccacgaattacaggaaaaactgagtccgctgggtgaggaaatgcgtgatcgggcccgagcccacgtggatgccctaaggacacatctggccccctatagtgacgaacttagacagtgtcttgctgcccgtttggaggcccttaaggagaatggcggcgcacggctcgcagaataccatgcgaaggcgacggaacacctgagcacactcagcgaaaaagcgaagccagcccttgaggacttgcggcagggattgctcccagtgctggagtccttcaaggtctcattcctttcagctcttgaagagtacacaaaaaagctgaacactcagtag

SEQ ID NO: 2338 - DNA, 804 bp, Artificial Sequence
  Description of Artificial Sequence: Synthetic coding sequence
atgaaggctgcggtgctgacactggcagtgttgtttttgactggctcccaagctagacatttttggcaacaggacgaaccacctcagtctccatgggatagggtgaaggatttagcaaccgtttacgttgacgtcctgaaagacagcgggcgcgactatgtctctcagttcgaagggtccgctctgggtaagcagctgaatctgaagttactagataattgggacagtgttacttctaccttctcaaaactccgggagcagttgggacccgtcacgcaggaattctgggacaacctggagaaagagaccgaagggctgcgtcaggagatgtcaaaagatctggaggaggttaaagctaaggtccagccctacctcgacgacttccagaaaaaatggcaggaagagatggaattataccgacagaaagttgaacccctgagggcagagttacaggagggagcacggcagaagctccacgagctgcaggaaaagttatcaccccttggagaggaaatgcgagactgtgccagggcccacgtcgacgccctacgaacccacctcgccccgtatagcgatgagctgcgccagcgcctggcagcccgcctggaggctctgaaagagaatggtggtgcacggttggctgaataccacgctaaggccaccgagcatctgtccaccctcagtgaaaaagccaagccagctctagaggatctcaggcagggtctgctccctgtgctagaaagcttcaaggtctctttcttatccgctctagaggagtataccaagaaacttaacactcagtag

SEQ ID NO: 2339 - DNA, 804 bp, Artificial Sequence
  Description of Artificial Sequence: Synthetic coding sequence
atgaaggccgcagtgttaacgctcgctgttctgttcttaacaggatcacaagcacgccatttttggcaacaggacgagccaccacagtccccgtgggatcgcgtgaaggatttggcaactgtgtatgttgacgtcctgaaggatagtggccgcgactatgtctcccagtttgaaggaagcgctttgggcaagcagctgaatttaaagcttctggacaactgggatagcgtcacttcgacgttctcaaagctgcgggagcaactcggtcccgtgacgcaggaattttgggacaatctggagaaagaaacggagggtctgagacaagagatgagcaaggatctggaggaagtaaaagcaaaggtccagccttatctagatgacttccagaagaagtggcaggaggaaatggaattgtatagacagaaggttgagcccctgcgagcagagctccaggagggagcccgtcagaagctgcacgagctgcaggaaaagctcagcccactaggggaggaaatgagagaccgcgcaagagctcatgtcgacgcgcttaggacccacctcgccccatacagtgatgagttgcgccaacgcctagctgcaaggctggaggccctgaaggagaacggcggcgcaagactagccgagtatcacgccaaagccacagaacatctgagtaccctatccgaaaaagccaagcccgccctggaagacctgcgacaggggcttctgcctgtgctggagagttttaaggtcagctttctcagtgccctggaagagtatactaaaaagttgaacacacagtag

SEQ ID NO: 2340 - DNA, 804 bp, Artificial Sequence
  Description of Artificial Sequence: Synthetic coding sequence
atgaaggccgcggtcctgacacttgctgtgttgttcttaacagggagccaggcccgccatttctggcaacaggatgaacccccccagagtccgtgggatagagttaaggacctggccactgtatatgtggatgtgcttaaggacagcggaagggactatgtatcacagtttgagggcagcgcactcggaaaacaactgaacttaaagcttctcgataactgggattccgtgacctcgacttttagcaaacttcgggagcaactgggccccgtgacccaggaattctgggataatctggagaaggaaaccgaaggcctcagacaggaaatgagcaaagatcttgaggaggtgaaggcgaaggtgcagccttatttagacgacttccagaagaaatggcaggaggaaatggaactgtatcgccaaaaggtcgaaccactgagagccgagctccaggaaggcgcccggcagaagctgcatgagctgcaggaaaaactgtcccctctcggcgaggagatgagagatcgggcccgtgcacacgtagatgctctccgcacacatttggccccttatagcgatgagctcagacaaagactggcagctcgtctggaggcccttaaagagaacgggggcgctcgcctggccgagtaccacgccaaagccacagagcatctgtcgactttatcagaaaaggctaagccagctttggaggatctgcgtcaaggcctcctgccagtccttgagtctttcaaagtgtctttcttgagtgcgctcgaggagtacacgaagaaactgaatactcagtag

SEQ ID NO: 2341 - DNA, 804 bp, Artificial Sequence
  Description of Artificial Sequence: Synthetic coding sequence
atgaaagctgccgtgctgaccctggccgttttgttcttgacaggcagccaggctagacacttttggcagcaggacgaaccaccgcagtccccttgggaccgcgtgaaagatctggcaacggtctacgtcgatgtgctcaaggatagcggaagagactatgtgtctcagtttgaaggttcggcactaggaaagcaactgaacttgaagctgcttgataattgggattccgtcacatcgacattctcgaaactcagagagcagttaggccctgtgacccaggagttttgggacaatctggaaaaggagacagaaggactgcgccaagagatgtcaaaggacctggaggaggttaaagctaaagtccagccttaccttgatgactttcagaagaaatggcaggaggagatggagctctatcgacagaaggtcgagcctctgcgggccgagcttcaagagggggcacgacagaaacttcacgagcttcaggaaaaactttcccccctgggcgaagagatgagagaccgcgcccgggcgcatgtggacgcccttagaactcatctggcaccgtattccgatgagttgcgccaaaggctggccgcccgcctggaagcgttaaaggaaaacggaggagcacgcttagccgaataccatgccaaagccaccgaacacctctccaccctgtccgaaaaggctaaacccgcactggaggacctacgccagggactcctgcccgtgctggagagcttcaaggtatccttcctgagcgcattagaggaatacaccaagaagctaaacacacagtag

SEQ ID NO: 2342 - DNA, 804 bp, Artificial Sequence
  Description of Artificial Sequence: Synthetic coding sequence
atgaaggctgccgtcctgactcttgccgtgctatttcttactgggagtcaagcccggcacttctggcagcaggacgagccaccccagtctccctgggaccgcgtgaaagatttggcaactgtatatgtggacgtccttaaagattcaggtagggactatgtgagccagttcgaaggcagcgcacttggcaaacaactgaacttaaagctgcttgataactgggactccgttacctccaccttctccaaactccgagaacagctcggcccagtcacacaagaattctgggacaatctggagaaggagactgagggactacggcaggagatgagcaaggacctggaggaggtgaaagcgaaagtgcaaccctaccttgatgattttcagaaaaaatggcaagaggaaatggagctatataggcaaaaggtggaacccctccgcgcagagctgcaggagggcgccaggcaaaagctgcacgaactacaagagaaactgagccccctgggcgaggagatgcgcgaccgcgcaagagcacacgtggacgccctcaggacgcatctggccccttattctgatgagcttagacagaggttagcagcacgccttgaagccctgaaagaaaacggcggcgcaagactagccgagtatcatgccaaggccacggaacatctctctactctgagcgaaaaagccaagcccgcgctagaagacctgagacaaggtctcctgcccgtcttggagagcttcaaagtttcgttcctatccgctttggaagaatataccaaaaagcttaacacacagtag

SEQ ID NO: 2343 - DNA, 1653 bp, Artificial Sequence
  Description of Artificial Sequence: Synthetic coding sequence
atgacaggtgacaagggtccccaaagactgtccggttcctcatatgggagcattagtagtccaacttctccaacatctcccggtccacagcaagcaccccctcgagagacctatctctcagaaaagattcctatccctgatactaagcccgggacattttcactgagaaaactgtgggcttttactgggcctggcttcttgatgtcgattgccttcttagacccggggaacattgaaagtgatctgcaggcaggcgcggttgctggatttaagctgctctgggttcttttgtgggccaccgtgctgggactgctgtgccagagactggccgctagactcggggtggtaactggcaaagatctgggagaggtgtgccacctgtattatccaaaagtgccccgaaccgtgctgtggctaactatagagctggccatagtggggagcgacatgcaggaggtgatcgggacggctatagcgtttaatctgctgagcgctggccgaattcctttgtggggtggagtcctcatcacaattgtggacaccttcttttttttattcctcgacaactacggactgcggaagctggaggccttcttcgggctcttgattaccatcatggcgctcacctttggatatgaatacgtggtcgctagacctgaacagggggctcttctcaggggattgtttctaccttcttgtcccggctgcggtcacccagaattactccaggctgtgggcattgttggagctattatcatgccccacaatatctatttgcattctgcactggtcaagtcccgggagatagatcgcgccagacgcgccgacatcagagaagccaacatgtatttcctgatcgaggctactatcgcgctgagcgtgagctttataattaacctgtttgtgatggcagtgtttggtcaggccttctatcagaagacgaatcaagcagctttcaacatctgtgccaattctagtcttcacgattacgcgaagatcttccccatgaacaacgccaccgtggcagtggatatttatcaaggtggtgttatccttgggtgtctgttcggcccagcagccctatacatctgggcgattggcctgctggctgccggccagtccagtacgatgacagggacttatgctggccagttcgtaatggagggattcctaagactcaggtggtctaggttcgcaagggtcctgttgacccgatcctgtgctatactaccaactgttttggttgcggtgttccgagatttgcgcgatctttcggggcttaatgacctactgaacgtactgcagtctttgctcctaccttttgctgtgctccccatattgacattcacttccatgccaacgttgatgcaggagttcgctaacgggttactgaacaaggttgtgacgtcctcaatcatggttctggtgtgcgcaataaatctttactttgtcgtctcttacctgccgagcttacctcatcccgcgtattttgggcttgccgctcttttggctgctgcctacctgggactgagcacctatctcgtttggacttgctgcctcgctcatggggccacctttcttgctcattcatcccatcaccattttctatatggcctgttagaggaagaccagaaaggtgaaacctctggctag

SEQ ID NO: 2344 - DNA, 13035 bp, Artificial Sequence
  Description of Artificial Sequence: Synthetic coding sequence
atggacccaccccgcccagcccttctcgctttgctcgctctacccgccttgctgttgctgctcttagcgggggctagggccgaagaggagatgctcgaaaacgtgtccctggtgtgtcctaaagatgcaaccagatttaaacacttaagaaagtatacttacaactatgaggcagaatccagctccggcgtaccaggcaccgctgattctcgatccgccactagaatcaattgcaaggtcgagctcgaggtcccgcagctatgttcattcatcttgaaaacttcacagtgtacattgaaggaagtctacggatttaatcctgaaggtaaagctctcctgaagaagactaagaactcagaagagtttgctgccgctatgagccgctatgaacttaaattagctatcccagagggaaagcaggttttcctgtaccctgagaaggatgaaccgacctacattctcaatattaaaagagggattatcagcgctctgctggtgcctcctgagactgaagaggcgaagcaggttctgtttctggatacagtgtacggtaattgctcgacccatttcaccgtgaagacacgaaaaggtaatgtggcaactgaaatctctacagagcgcgatttggggcaatgcgacagattcaaaccgatccgcaccggcataagcccactcgcacttattaaaggcatgactcggcccctgtctaccctcatcagttcttcgcagtcctgtcaatataccctggatgcgaaacgcaaacatgtggcggaggctatttgcaaggagcaacacctttttctccccttttcctacaaaaacaagtatggtatggtcgcccaggtcacgcaaacgctcaagctggaggataccccaaaaataaactctaggttcttcggagaggggacgaagaagatggggctcgcttttgagagtacaaaaagtacctctccccctaaacaggctgaagccgtgttgaaaacacttcaggagcttaaaaaactgactatctccgagcagaacatccaacgagctaacttgtttaacaagctggtgacagaacttaggggtctctccgacgaggccgtgacatccctgctgcctcagcttatagaagtctcatccccgatcactctccaggcgcttgtccaatgtggccagccccagtgttcaactcatattctacagtggctgaagcgagtgcacgcaaatcccctgctgattgacgtggttacgtatcttgtggctctcatccctgagccctcagcgcagcagctgcgtgaaattttcaacatggctcgggaccagcgaagcagggccaccctgtatgctctgagccacgccgtcaataactaccacaagaccaatccaactggcacccaggagctgctcgacattgcaaattatctgatggagcagattcaggacgactgcactggcgacgaggattacacctatctgattttgcgggtcataggcaacatgggacagacaatggagcagctgacccctgagctgaaaagtagcatcctcaagtgtgttcagagtaccaaacctagcctgatgatccagaaggctgcaatacaggccttgagaaagatggagccgaaggacaaggatcaggaggttctactgcagacattcctggatgatgcatctccaggtgacaaacgcttggccgcttacttgatgttgatgagatccccaagccaggctgacataaacaagattgtccagatactcccatgggagcaaaacgagcaggttaagaattttgtggcatcacatatcgcaaatattcttaacagcgaagagctggacattcaagatctaaagaaactcgtcaaagaggcattgaaggaatctcagctgccgaccgtgatggactttaggaagtttagtcggaattatcagctgtacaagagcgtgagtcttccttcccttgatcccgcatctgcaaagattgaaggaaacctgatcttcgacccaaacaattacctgcctaaggagtctatgctgaaaacaacgttaaccgccttcggtttcgcatctgcagacctgattgaaatcgggttagagggcaagggatttgagcctaccctcgaggcactgtttggtaaacagggcttcttccccgattctgtcaacaaggcactgtactgggtgaacggacaagtcccggatggagtgagcaaagttctggtcgaccatttcggttataccaaggacgacaagcatgagcaggatatggtgaacggcattatgctgtctgttgagaaactgattaaagaccttaagagtaaggaggtgcccgaggcccgcgcctacctcagaattctgggagaagagctggggttcgcctcacttcatgaccttcaactgctcggcaagctgctcctgatgggagctagaactcttcagggaataccccagatgattggggaggtcatccgaaagggctcgaagaacgacttttttctccattacatctttatggagaacgcattcgaactgcctacaggggccgggttgcagctccagatatcctcctctggcgtaatagctccaggggcaaaagcaggagtaaagttggaggttgccaatatgcaggccgagttggttgctaaacctagcgtgagcgtagaattcgtgaccaacatgggaatcattattccagatttcgcccggtccggtgtccagatgaataccaacttttttcatgagtctggtctcgaggcccacgtggcgctcaaggctgggaagctgaagttcatcatcccttcccccaaacgcccagtcaagctactctccgggggtaacactctgcatctggtttcaaccaccaagacggaggtgatacccccattgattgagaatcgtcaaagctggtctgtgtgtaagcaagtgtttcctggactgaactactgcacctctggtgcctactccaacgcttcaagcaccgactcggccagctattaccccctcaccggtgacactagactagaactggaactgcgccctacaggcgaaattgagcagtatagcgtcagtgcaacctacgagttgcagcgcgaggatagggctctggtcgataccttaaagttcgtgacccaggcggagggcgcgaaacagacagaagccactatgacattcaagtacaatagacagtctatgaccctttctagcgaagttcagatcccagatttcgatgttgacctgggaactatattgagagttaacgatgagtcgacagaggggaagaccagctatcggctcacactggatatccagaacaagaagatcactgaagtagcgctaatgggccacctgagctgtgacacgaaagaggagcggaagatcaaaggagtgatctccatcccgcgtctccaagccgaagccaggtcagagattctggctcactggagtcccgccaagctacttctgcaaatggactcttctgcgacggcctacggcagcacagttagcaagcgcgtggcctggcactatgacgaggagaaaatcgagttcgagtggaacactggaacaaatgtggataccaaaaaaatgaccagtaactttcccgtggacctgagtgactatcccaagtctcttcatatgtatgctaacagactgttagatcatagggtgccgcagactgacatgacctttcgtcatgtggggtccaagttgattgtagccatgtcctcatggctccagaaggcaagtggcagcttgccgtatacacaaactttacaggaccacctgaatagcttgaaggagttcaatctccagaacatgggtttgccagacttccacatccccgagaatctatttcttaagtcagatgggagagtaaaatatacgctgaataaaaatagccttaagatagaaatacccttgccttttggcggaaaaagttctagagatcttaaaatgctcgagacagtgcgcactcccgcactacatttcaaatctgtcggatttcaccttccctcccgagagttccaagtgccaacctttacaattcctaagctctaccagttgcaagtccctctgctcggcgtccttgatttatcgacgaacgtgtattccaatctctataactggagtgcatcatatagcggtggcaatacgtccacagaccacttcagtttgcgcgcaaggtatcacatgaaggcagatagcgtagtcgacctgttgtcatacaacgtgcaagggagtggcgagacaacttatgaccacaagaatacattcacgctgtcctacgacggcagcctgagacacaagttcctcgattccaacattaagttcagccatgtggagaagctcggcaataaccccgttagcaaagggctgcttattttcgatgcttcctcttcctggggcccacaaatgtccgcgtctgtccacctggactccaaaaaaaagcagcacctgtttgttaaggaagtaaagatcgacggacagttcagggtttcctccttctatgccaaaggaacttacggcctgagttgccagagagatcccaacactggccggcttaatggagagtcaaatctccgtttcaactcatcttatctccagggtaccaatcagattaccgggaggtatgaggatgggactctctctttgacatcaacctccgatcttcaatcaggaatcatcaaaaacaccgcatcactgaagtatgagaactacgagctaactcttaagagcgataccaatggtaagtacaagaacttcgctacatccaacaaaatggacatgacattttccaagcagaatgcactgctcagatcagaataccaggcagattacgagagcctgagatttttctctctactgagcgggagcttgaactctcacggactcgagctgaacgcagatattcttgggacggacaaaatcaatagcggcgcccacaaagcgaccctccgcatcgggcaggacgggatctctacaagcgcaaccaccaatttgaagtgctcactgctagttctggagaacgagctgaatgctgagctgggactgagcggtgcttcaatgaaactgacaactaatggccggtttcgcgaacataacgcaaagttctctttggatggtaaggctgccctgaccgagctttcattggggtctgcctaccaggccatgattctgggggttgattccaaaaatatattcaattttaaagtttctcaggagggtctaaaactctccaatgatatgatggggtcctacgctgagatgaagtttgaccacaccaactcactgaatatagccggcctaagtctggatttcagctctaagttggataatatctatagttctgacaagttctacaagcagacagtgaacctgcagttacagccatacagtctggtgacgactctcaacagcgacctgaaatacaacgcacttgatctcacaaataacggaaaattgcgactagagccccttaaactgcatgtggcgggcaatctgaaaggggcctatcagaataatgaaatcaaacatatctacgcaataagctccgctgctctatctgcttcatacaaggctgatacagttgctaaagtgcagggtgtggaatttagtcatagattaaacaccgacattgctggtctggcgagtgctatcgatatgtccactaactacaatagcgactcattgcacttctccaacgtgtttcgtagcgttatggctccgtttacgatgacaatcgatgcgcatacaaacggtaatggaaagctggcactatggggagaacataccggccagttgtatagtaaattcctcctcaaagccgagcctttggcttttaccttttcccacgattataaaggctcgacatcacatcatttggtcagccgtaagtctattagcgctgccctcgagcataaggtgtcagcacttctgaccccggccgagcagaccggcacttggaagctcaaaacgcagttcaataacaacgagtacagtcaagacctagatgcgtacaacacaaaagataagataggtgttgagttgacaggcagaaccttggcagatctgaccttgttggacagcccaatcaaagttcccctgttactctcggaaccaatcaatatcattgacgcactggagatgcgggatgctgtggagaagccccaggaattcactatagtggcctttgttaaatacgacaaaaaccaggatgtccattccatcaatctgccttttttcgagaccctccaggaatacttcgagaggaaccggcaaactattatcgtggttctggaaaacgttcaacgaaatctgaaacacataaacatcgatcagtttgtgcgcaagtatcgagctgctttggggaagttgccacagcaagccaatgactatctcaactcgtttaattgggagcgccaggtcagccacgccaaggagaagctcactgcactgacaaagaagtaccggatcacagagaacgacattcagattgcgttggatgacgccaagatcaacttcaatgagaaacttagtcaactgcagacatatatgatccagtttgatcaatacataaaagacagctacgacctgcatgacctaaagatcgctatcgcgaacattatcgacgaaattattgagaagttgaaaagtctagacgagcactaccacattcgagtgaacctggtcaaaaccattcacgaccttcacctgtttattgagaacatcgattttaataagtcaggcagcagtactgcttcatggatacagaacgtggacacaaaataccagattcggatccagattcaggaaaagctacagcagctcaaacggcatatccagaacattgacatacagcatctggctggcaagctaaaacagcatattgaggctatcgacgtgcgtgtgcttctggatcagctcggaaccacaatctctttcgaaagaattaatgatattctggagcacgtcaaacactttgtgattaatcttatcggtgatttcgaagtcgccgagaagataaatgcatttcgggccaaagtccatgaactgattgagcgctacgaggtggaccaacagattcaggtgctgatggataagctggttgagctggcccatcagtacaaactcaaggagactatacagaagctgagcaacgtcttacaacaggtgaaaatcaaagactattttgaaaaacttgtcggttttattgatgatgccgtcaagaagttgaatgaactgtccttcaaaaccttcatcgaagacgtcaacaagtttctagatatgctgatcaaaaaacttaaaagtttcgattaccaccaattcgtggatgagaccaacgacaagattcgtgaggtgactcagcgcctgaacggtgagatccaggcactggagctccctcaaaaagcagaggcactgaagctgttcctggaagaaaccaaagctacagttgccgtgtatttggaaagcctccaggatactaaaattacgctgatcatcaattggctgcaggaggctctatcttctgctagcctggctcacatgaaagctaaattccgggaaaccctggaagatactcgcgatcggatgtatcagatggatattcagcaggagctgcagaggtacctcagcttggtcggccaggtgtacagtaccttggtaacatacatctctgattggtggactttggctgctaagaacctgaccgacttcgctgagcagtacagcattcaagattgggcgaaacgcatgaaggcccttgttgagcaggggttcaccgtgcccgaaatcaagaccattctgggcactatgccagcgtttgaagtttctttgcaggccctccaaaaggcaacatttcaaaccccagacttcatcgtcccgctcaccgatttgcgcataccctccgtccagatcaactttaaggatttgaaaaacatcaaaatcccttctcgttttagcaccccagagttcactattctcaacacttttcacatcccaagttttaccatcgatttcgttgagatgaaggtcaagatcattaggacgatcgatcagatgctgaatagcgagttgcaatggcccgtgcctgatatttatttacgtgacctgaaggtcgaagacatacctctggctcggatcacacttccggacttccgcttgcctgagattgcaattccagaattcattatcccgactctgaacctgaatgactttcaagtccctgatctgcacatccctgagttccaactgccccatattagccatacgattgaggtgccaaccttcggcaagttatattccattctgaagattcagagccccctatttacactcgacgctaacgccgatattggtaacggcacaacatccgccaatgaggctggcattgcggcaagtatcacagcaaaaggtgaatctaagctggaggtcctgaattttgactttcaggccaatgcccagctgagtaaccctaaaataaaccccttggcccttaaagagtccgtaaaattctccagcaagtatctccgaacagaacacgggagtgagatgttgttttttggaaacgcgatcgaaggcaagtccaacacagtggcaagcctgcataccgagaaaaacaccctggaattatcaaatggagtcatagttaagattaacaatcagctcaccctggactccaatacaaagtacttccataaactgaacataccaaaactggactttagttctcaggcagatttacggaacgagatcaagacacttctgaaagcggggcacatagcctggaccagcagtggtaaaggttcatggaaatgggcatgtcctagatttagtgatgaaggtacacatgagagtcagatcagttttaccattgaggggcctctgactagttttggtctatccaacaaaattaattccaagcacttgcgggtgaaccagaatctcgtgtatgagtcaggctcattaaatttctccaagttggaaatccagagtcaggtggattctcagcatgttgggcactctgtgctgacagctaagggaatggccctgtttggtgagggaaaggccgagttcacaggccgccatgatgcacacttgaacggaaaagtcattgggactctcaagaattccctttttttttcagcgcagcccttcgaaattacagctagcaccaataatgaaggcaacctgaaggttagattccccctcagactgaccggtaagatcgactttttaaacaactacgccctcttcttatcgccaagtgctcagcaggcttcttggcaggtgagtgctcgttttaaccagtataaatataaccagaatttctctgccggaaacaatgaaaatatcatggaggctcatgtcggcataaacggtgaagctaatctagacttcctgaacatcccgctaaccatccccgaaatgagactcccctacactatcatcacaacaccaccattgaaggacttcagcctgtgggagaagacaggacttaaggaatttctgaagactacgaaacaatcctttgatctcagcgtgaaagcgcagtacaagaagaacaagcaccggcacagcatcacaaacccacttgccgttttatgtgaattcatatcccaatccattaaaagcttcgataggcatttcgagaagaacagaaataatgctctggactttgtgacaaagagctacaacgagacaaaaatcaagttcgataagtataaggcagagaagtcacacgacgagctgccaagaacattccagatcccagggtacacagtccccgttgtcaacgttgaagttagcccctttaccattgagatgagtgcttttggatacgtgttccctaaagccgttagtatgccgtccttttctatactcggctcagatgtgagagtccctagttacacgttaattctgccgtctctcgagttgccagtgttgcacgtgccaagaaatctgaaattatctctgcccgatttcaaggaactttgtacgatctctcatattttcattcctgctatgggcaacatcacctatgatttctccttcaagtccagcgtgattaccctcaacacaaatgcagagctgttcaatcagagtgatatcgtggctcatcttctgagtagctctagtagcgtcattgatgccttgcagtacaagctcgaaggtactacaagactgactcggaaaagaggacttaagctcgcaactgccctatccctgtctaataaattcgtggaagggtcgcataactccaccgtgagcctgacaaccaagaacatggaggtctccgttgccactactaccaaagcgcagatcccgattctacgaatgaatttcaagcaagaactgaatgggaacacaaaaagcaagcctacagttagttccagtatggaatttaaatacgacttcaactcaagcatgctatacagcaccgctaaaggtgcagtagatcataagctctcgctggagtccctgaccagttatttttccatcgaaagttcaactaaaggagatgtcaagggaagtgtcttatcgcgtgaatatagtgggactatcgccagtgaagccaacacctacctgaatagtaagagtacccgatcctctgtgaagctgcagggaacttctaagatcgatgacatctggaacctggaggttaaggagaatttcgccggcgaggctacgctgcaaaggatctactctctctgggagcattcgaccaagaatcatctgcagctggaaggcctgttcttcactaacggagagcacacatcaaaggccaccctcgaactatcaccatggcagatgtcagccttagtgcaggttcacgccagtcagccatctagcttccacgatttccccgacctaggccaggaggtggcactcaacgctaacacaaagaatcagaagattagatggaagaacgaggtccgtatacattctggctcatttcagtcacaggtggagctctctaacgaccaggagaaggcccacttagacattgctggcagcttggagggtcacctccgtttcctgaagaatatcattcttcctgtgtatgataagtctctgtgggactttctcaagctcgacgtcactacaagcattgggagaaggcagcatctcagggttagtaccgccttcgtctatacaaagaatccgaacggttattccttttccattcccgtgaaggttctggctgacaaattcatcatccctggcctgaaactgaacgatctcaactccgtccttgtgatgccaacttttcacgtgccttttaccgaccttcaggtgccatcgtgcaaattggattttcgggagattcagatctataagaagctaagaactagcagtttcgccctgaatcttccaacgctgcctgaggtaaaattccctgaggttgacgttctcactaagtatagtcagcctgaagacagcctgattcctttcttcgagattacagtacctgagagccagctgactgtgtctcagtttactctccctaagagcgtatcagatggcatagccgccctggaccttaacgctgttgcgaataagatcgctgattttgagctgccgacaattattgtccccgagcaaactatcgagatccccagcatcaaattttccgtaccagcaggaatcgttattccctctttccaggctcttactgctagattcgaggttgacagccccgtgtataatgcaacctggagtgctagtctcaagaataaagccgactatgtagagactgtgcttgattccacctgctccagcactgtccagtttttggagtacgagttaaatgttcttggcacacacaagatcgaagatgggaccctcgccagcaagaccaaagggaccttcgcccaccgtgatttcagcgctgagtacgaagaggatggaaagtacgaaggcctccaagagtgggaaggtaaagcgcacctaaacattaagtcgccagcgttcacagatttgcatttgcgataccagaaggacaaaaaggggatctcaactagcgccgcttcccctgccgttgggacggtcggaatggacatggacgaagatgatgattttagcaaatggaatttctattactccccccaatctagccctgataaaaaactgacaatatttaagaccgaattgcgcgtcagagaatctgatgaagagacacagatcaaggttaactgggaggaagaggccgcttccgggctgcttaccagcctgaaagacaatgttccaaaggccaccggcgtactgtacgattacgtcaataaataccactgggagcatacagggttgaccctgcgcgaggtatcatcgaagcttcgtaggaatctgcagaacaacgcggagtgggtctatcaaggcgcgatccgccagattgacgacatcgacgtgagatttcagaaggccgccagcgggacaacaggaacgtaccaggagtggaaagataaggcccagaatttgtaccaggagctgctgactcaggagggacaggcgtctttccagggactgaaagataatgtttttgacggcctagtgcgcgtgactcaggaattccacatgaaagtcaaacatctcatagatagtctcatcgacttcttaaactttccaaggttccaattccctggcaaaccaggaatttatacccgagaggagctgtgcactatgtttattcgagaggtagggaccgttctgtctcaggtttactctaaggtgcataatggctccgagatcctgttttcatactttcaggaccttgtgatcaccctccctttcgagctgagaaagcacaaactgattgatgtcatctcaatgtatagagaactgctcaaggatttgtcgaaggaggcccaggaggtcttcaaggccatacagtccctaaaaactacagaagtactgcgcaatcttcaggatctgctgcagttcatcttccagctgattgaggataatatcaaacaactcaaagagatgaaattcacttacctgatcaactatatacaggacgagatcaacacaatcttcagcgactacattccgtgtttctag

SEQ ID NO: 2345 - DNA, 798 bp, Artificial Sequence
  Description of Artificial Sequence: Synthetic coding sequence
atgaaaaaggaagtctgcagtgtggcctttttaaaagctgtatttgccgaatttcttgccactctgattttcgtgtttttcggattaggctcagctctcaagtggccctctgccttgcctacaatcctccagattgcgctcgccttcggcctggccatcggcacattagctcaggcgttagggcctgtctctggagggcacatcaaccccgcaatcacacttgcactcctcgtgggcaaccaaatctctctgctacgggccttcttttatgtcgcagcccagctggtgggagctattgccggagcgggaattctgtacggtgtcgccccgttgaatgcccgcgggaaccttgctgttaatgccctgaataacaacacaactcagggacaggctatggtagtcgagctgattctaacatttcagctcgccctgtgtatattcgcctccaccgattccagaagaacatcgcccgtgggttcaccagctttatcaatcggactcagcgtgactctgggacacctggttggcatttactttacaggttgcagtatgaaccccgcacgttccttcggtcccgcagttgtgatgaataggttctctccagcccattgggtgttttgggttggaccaattgtgggtgcagtgctggctgctatcctctacttttatctgctgttccctaacagtctcagtctgtcagaacgggtggctataattaaaggcacttatgagcccgacgaggactgggaggagcaacgcgaggaacggaagaaaaccatggaactcaccacccgctag

SEQ ID NO: 2346 - DNA, 993 bp, Artificial Sequence
  Description of Artificial Sequence: Synthetic coding sequence
atgagtgcaaaaagtaggaccattggcataatcggagcccccttttccaagggacaacctagagggggagtagaagagggccccaccgtcttacgtaaagctggcctgctcgagaaactcaaggaacaggtgactcagaactttctgattctggagtgtgacgtaaaggattatggagacctgccattcgcagatattccaaacgacagcccatttcagatcgttaaaaaccctagaagtgtaggtaaggcctccgaacagctcgccggcaaggtcgccgaggtcaagaaaaatgggcggatttctctcgtgttaggaggagatcactccttggctataggcagtatctcaggccatgctagagtgcaccctgacttgggtgtgatttgggtggatgcacacactgacatcaatacacccctcaccacaaccagcggaaacctacacgggcagccagtaagttttctgctcaaagagttgaaaggcaaaatcccagacgtacccggctttagctgggtgaccccctgtattagtgccaaggacatcgtctacatcggcctgagggacgttgatcctggggagcactacattctgaaaactctgggaatcaaatatttctcgatgaccgaggtggatcgattgggcattgggaaagtgatggaggagaccttgtcttatctgctcggtaggaagaagaggccaatacacctgtctttcgatgtcgacggtttggaccccagcttcacaccggccactgggacacctgtggttggcggacttacctacagggaaggcctgtatattactgaggagatatacaagaccgggctgctgtctggccttgatataatggaggtcaatccaagcctcgggaaaaccccggaagaggtgacacgcaccgtaaacactgctgttgcgatcactctggcgtgcttcgggttagcccgagagggcaaccacaagccgatagactaccttaaccccccgaaatag

SEQ ID NO: 2347 - DNA, 969 bp, Artificial Sequence
  Description of Artificial Sequence: Synthetic coding sequence
atgtcagctaaatctagaaccataggaatcataggtgctcctttctcgaagggtcagccgcgtggcggcgtggaggaaggccccacagtcctgcggaaggccggcctgttggaaaagttaaaggaacaggagtgcgatgtcaaggactacggtgatctccccttcgccgatattccgaacgatagtccctttcaaattgtgaagaatcccaggtcagtgggcaaggccagcgagcagttggccgggaaagttgccgaagtcaaaaagaacggccggataagcctagtgttgggaggcgatcattccctcgctattgggtccatatctggacacgcccgcgtgcaccccgacctgggcgttatatgggtggatgcacacactgacattaatacgccactgaccacaacctcaggtaacctccatggacaaccagtgtcttttctcctcaaagagcttaagggcaagatccctgatgtgccaggattcagctgggtcaccccttgtatctccgctaaagacattgtatatatagggctgagagatgttgatcccggtgagcattatatcttgaagacgttaggtatcaaatacttctccatgactgaggtggaccgccttggcatagggaaagtgatggaggagacactttcttacctactgggcaggaagaagaggccaattcacctgtcgtttgatgttgacggactcgacccttccttcacaccagccaccggcacccccgtggttggcggactcacctaccgtgagggtctgtatattacagaagagatttataagacgggcctgcttagcggactggatattatggaggtaaacccctcccttggaaaaacacccgaagaggtgactcgcaccgtaaacactgccgtggcaattaccctggcctgtttcggactggcacgggaaggaaaccacaaacccatcgactacctcaacccacccaaatag

SEQ ID NO: 2348 - DNA, 711 bp, Artificial Sequence
  Description of Artificial Sequence: Synthetic coding sequence
atgtcagctaagtcaaggacgatcggcatcatcggtgcccctttcagtaaaggccagccgcgcggcggtgtagaggagggtcccactgtactgaggaaggcagggttgctagaaaaattgaaggagcaggagtgcgacgtcaaagactacggagacctacccttcgcggacatcccaaatgactccccctttcagatcgtgaagaaccctcgaagcgtggggaaggccagcgagcagctggctggaaaggtcgcggaggttaaaaagaatggtcggatttcgctggttctcgggggcgaccatagtctggctattggtagcatcagcggccatgcccgcgtccaccccgatttgggggtcatttgggtggacgcccacacagacattaataccccgctgacgaccacgagcgggaacctgcatggacagcctgtctcattcttgttaaaggagctaaaaggaaagattcccgatgtgccaggcttttcctgggtcacaccttgtatctctgcaaaggatatcgtatacatcgggctgcgggacgtggatcccggtgaacattacatcctcaagaccctcggaatcaagtatttctcaatgacagaggttacccggacagtcaataccgcggtcgccatcactctggcttgttttggcctggccagagaggggaatcacaagccgattgattacctaaacccaccaaaatag

SEQ ID NO: 2349 - DNA, 1395 bp, Artificial Sequence
  Description of Artificial Sequence: Synthetic coding sequence
atggcatcagagtccggtaaactctggggcgggcgctttgtaggcgccgtggaccccatcatggagaagtttaacgccagcattgcctacgataggcacctttgggaagtggatgtacagggctccaaggcttacagccgcggtctggagaaggctgggttactgactaaggctgaaatggaccaaattctgcacggactcgacaaggttgccgaagagtgggcccaaggtaccttcaagctgaattcgaatgacgaagacatccacactgccaatgagcggagattaaaggagttaataggtgcgaccgcaggcaaactacacacggggcggtcaagaaacgaccaggtggttaccgacctaagactgtggatgcgtcaaacctgctccactctcagcgggcttctgtgggaacttataaggacaatggtggatagagcggaagccgaacgcgatgtgctttttccaggatatactcacctgcaaagggctcagcctatacgttggtctcattggatcctctctcatgccgttgctttaacgagagattctgaacggctgctggaggtcaggaagcgaattaacgtactgcctctggggagcggcgctatcgctgggaaccccctcggcgtggaccgcgaattactgcgcgccgaactcaattttggagcgatcactctgaacagtatggacgctacttctgagcgggattttgtggccgagttccttttttgggccagtctgtgcatgacacatttgagccgaatggccgaggatctgatcctttactgcactaaagagttctcgtttgtgcagctcagtgacgcgtactcaactggttcatcgctaatgcctcagaaaaagaatcctgacagcctcgagcttattagatcgaaagccggacgtgtctttggtagatgcgccgggcttttgatgactctaaagggcctaccatcaacctacaacaaggatctccaggaagacaaggaggcagtgtttgaggtgtcagatactatgtccgccgtcttgcaggttgctactggcgtaatctccacgctgcagatccatcaggagaatatgggccaagctttatcccccgatatgctcgccacggacctggcctactacctcgtaagaaaagggatgccattcaggcaggcgcacgaagcctcagggaaggccgtgttcatggccgaaacaaaaggggtagctctgaaccaactgagcttacaagaactccaaaccatctctccgctctttagtggggatgtgatctgcgtgtgggattacggccactctgtcgagcagtacggggctttgggcggaaccgctagatcctctgtggattggcagatcaggcaggtgagagccctgttacaggcccagcaggcatag

SEQ ID NO: 2350 - DNA, 1317 bp, Artificial Sequence
  Description of Artificial Sequence: Synthetic coding sequence
atggcgtctgagagcggcaaattatggggggggagatttgtaggagcagtggaccctattatggagaaattcaacgctagtattgcctatgacagacacctgtgggaagtagacgtccagggaagcaaggcatatagcaggggccttgagaaggccggactgctgaccaaagcagaaatggaccagatccttcacggcctcgataaagtggctgaagaatgggcccagggcaccttcaagctaaattctaacgacgaagatattcacacagcgaacgagcgacgactgaaggagctgattggagctactgccggtaagctgcatacaggaagatcacggaatgaccaagtggtcacggatcttagactttggatgaggcaaacgtgttcgactttgtctggtctcctgtgggaactcattagaactatggtggatagggccgaggccgagagagacgtgctctttcctggctatacacatcttcagagggcccagcctattcggtggagtcactggattttatccggagccattgcagggaaccctctgggtgtggaccgcgaactgctaagggcagagctgaacttcggcgccattacccttaattcaatggacgcgacgagcgagcgtgatttcgtcgcggagttccttttttgggcgtccctttgtatgacccatctatcacggatggccgaggaccttattctgtattgcacaaaggaattttcctttgttcagctgtctgatgcttattccacaggctcttcgctgatgcctcagaagaaaaatccggactctctggaattgatccggagcaaggccggccgcgttttcgggcgttgcgccgggctgctaatgactttgaagggattgccgtctacttataacaaggacctgcaggaagacaaagaggctgtgtttgaagtctccgacaccatgagtgccgttcttcaggtcgccactggagtaatctccacactgcagattcaccaagaaaacatggggcaagctctgtcacctgatatgctagctacggacctggcatactaccttgtccgcaaggggatgccctttcgacaggcccacgaggcttctggtaaagccgtcttcatggcagaaacgaagggggtggccttgaatcagttatctttacaggagctgcagactatttcaccactgttttctggcgacgtgatctgcgtctgggattacggtcatagcgtggagcagtatggcgcgctcggcggtaccgctcggtcttctgtggattggcaaattaggcaggttagagcccttctccaggctcagcaggcttag

SEQ ID NO: 2351 - DNA, 1335 bp, Artificial Sequence
  Description of Artificial Sequence: Synthetic coding sequence
atggctagtgagtcaggcaagctatggggcggaagattcgttggagcagtcgatcctattatggagaagtttaatgcaagtatcgcatacgatcggcacctctgggaagtcgacgtacagggcagtaaggcatactcaagggggctcgagaaggccggtctcctgaccaaagccgagatggaccagatactccatggattggacaaggtggctgaggagtgggcccagggcacattcaaacttaatagcaatgatgaggacattcatacagcgaatgaaaggaggctgaaggaacttatcggcgcaacagccggtaaactccacactggtaggagtcggaacgaccaagttgtgacagacctgaggctttggatgagacagacttgttctacactttccgggctgctgtgggagctaattcggacaatggtagatcgcgccgaggccgagcgggacgtgctcttcccaggttacactcatttgcagcgcgcgcagcccatcagatggagccactggatcttgtctcacgccgttgcacttaccagggattccgagcggctgttggaagtgagaaaaaggatcaatgttctgcctttagggagcggtgccattgcaggcaaccccctgggggttgatcgtgaactccttcgggcagagctgaactttggtgcaatcactctcaactctatggatgctacaagcgagcgtgactttgtcgctgagttcctgttttgggcctcactgtgcatgacgcacctgagtaggatggccgaagacctgatactgtactgcacaaaagaattctccttcgtgcagcttagtgacgcttattccacagggagtagtttaatgcctcagaagaagaacccagacagtctagagctgatccggtccaaagccggcagggtgttcgggagggaagacaaagaagcagtgttcgaagtatcagacaccatgtccgccgtattgcaggtagctacaggagttatttctacactgcagatccaccaggaaaacatgggtcaggcactgtcaccagacatgttggcaaccgatctcgcatattacttggtccgaaaaggtatgcctttccggcaggctcacgaggcctctggaaaagctgtatttatggccgagactaagggcgttgccctgaatcaactcagcctgcaggaactgcagaccatcagccctctgttctccggcgatgtgatttgcgtgtgggactatggtcactccgtggaacagtacggcgcgctggggggaaccgcacggtcttctgtggactggcaaatccgccaagttcgagctctcctgcaggctcagcaggcctag

SEQ ID NO: 2352 - DNA, 1395 bp, Artificial Sequence
  Description of Artificial Sequence: Synthetic coding sequence
atggcatccgagagcggcaaattgtggggcggacgattcgttggtgccgtcgatccgattatggaaaaatttaacgcatcgatagcctacgaccgccatctgtgggaggtagatgtacagggatcaaaggcctatagccgcgggctagaaaaagccgggcttctgacaaaggccgagatggaccagatccttcacggcctggacaaggtagccgaggagtgggctcaggggacatttaagcttaatagtaacgacgaagacattcacaccgcgaacgaacggcggttgaaagagctgattggggcaactgcaggcaaattacacacaggtcggagccggaacgaccaggttgtcacggacctgaggctgtggatgaggcaaacatgttctacattgtctgggctcctctgggagctgattcggacaatggtagatcgtgccgaggccgaacgagacgtcttgtttccaggttacactcacttacaaagggctcagcccatccgttggtcccactggatactgtcccatgccgttgctctgacccgagattccgagagactcctggaggtcaggaaacgcatcaacgttctgcctttaggctccggagctatcgctggcaaccctctgggcgtggacagagagctcctcagggcagagttgaactttggagccatcactctgaatagtatggacgccacaagcgaacgcgatttcgtcgccgagttcctgttctgggccagcctgtgcatgacacacttatctagaatggctgaagacctcatcctgtactgtactaaggagtttagttttgtacagctcagcgacgcctacagcaccggatcctcgttgatgccccagaagaagaatcctgattccctggaactgatacgctcaaaagctggaagggtgttcggcagatgcgctggattgctgatgactttaaaaggactacctagtacgtacaataaggatctgcaggaagacaaagaagcagtgtttgaagtatctgacacaatgtccgccgtcctgcaagtagccaccggcgtgatctccaccttacaaattcaccaagagaacatggggcaggctttgtccccggacatgctcgctactgacctcgcttattacttggtgcgcaagggcatgccctttcgacaggctcacgaggccagtggcaaagctgtattcatggcagaaacgaagggggtggctctgaaccagctctcgctccaagagttacagactatctcccccctcttctctggagacgtgatttgtgtgtgggactacggacactcagttgagcaatacggggctcttgggggcaccgccagaagttcagtggattggcagataaggcaggtaagggctctgctgcaggctcagcaggcatag

SEQ ID NO: 2353 - DNA, 297 bp, Artificial Sequence
  Description of Artificial Sequence: Synthetic coding sequence
atggaaaagtttaacgcttcaattgcttatgacaggcatctctgggaggtagatgtacagggtagtaaggcctattctcggggacttgagaaggctgggctgctaaccaaggctgagatggaccagatattacacggtcttgataaagtggctgaggaatgggcacagggaacatttaagctgaattccaacgacgaagacatacatacagctaatgagcgtagactcaaagagctcatcggagccactgcggggaagctgcatactggccgctctcggaacgatcaggtgttatag

SEQ ID NO: 2354 - DNA, 1239 bp, Artificial Sequence
  Description of Artificial Sequence: Synthetic coding sequence
atgagctctaaagggtcagtagtgctcgcatattctggcggcttagacacttcctgcatccttgtgtggctgaaggagcaggggtatgatgtgattgcatatctggccaacattgggcagaaggaggactttgaagaggcacgtaaaaaggccttgaagctgggagccaagaaggtgtttatcgaagacgtgtcacgggaatttgtggaggaattcatctggcccgctattcaaagtagcgccttgtatgaagacaggtatctgctaggaacatctctggcgaggccctgcatcgcgagaaaacaggttgagatcgctcagagggaaggcgcaaagtacgtgagtcacggagctacaggaaaagggaatgaccaggttcgcttcgagctctcctgctactctctcgctccacaaataaaggttatcgcaccttggcggatgcccgagttttataaccgcttcaagggccgaaacgacctaatggagtacgcaaaacagcacgggatacctatccctgtgacgccaaagaacccatggtctatggacgagaatcttatgcatatctcctatgaggccggcattctagagaatccaaagaaccaggccccacccgggctgtatacaaaaacacaggaccccgctaaagcaccgaacacccccgacatcttagagattgaattcaaaaaaggagtaccggtaaaagtgacaaacgtaaaggacgggactactcaccaaacctcactggaactgtttatgtacctgaatgaggttgctggcaagcacggagtcggacgcatcgatattgtggagaaccgatttatcggcatgaaatctcggggaatttatgagacccctgctggtaccattctttatcacgcccaccttgatattgaggcctttactatggaccgagaagtccgcaagatcaagcaggggctcggtctgaagttcgccgagctggtatatactggcttttggcactctcctgagtgtgagttcgttagacattgcattgccaagagtcaggaaagagtggagggcaaggtacaggtgtccgttcttaagggacaggtatacatcctgggtagggaatctccattgtcactctataatgaagaactcgtgtctatgaacgtccagggggactacgagccaactgatgccacaggttttatcaacatcaactctctgcgactgaaggaatatcaccggctgcaaagcaaagtcacggctaagtag

SEQ ID NO: 2355 - DNA, 1239 bp, Artificial Sequence
  Description of Artificial Sequence: Synthetic coding sequence
atgtcttctaagggttcagtggtgttggcctactccggaggcttggatacatcgtgtatcttagtctggctgaaagaacaggggtatgacgtcattgcttacctggctaatataggtcagaaagaagatttcgaagaggcgcgcaaaaaggccttaaagttaggagcaaaaaaagtttttattgaggatgtgtcacgcgaatttgtcgaggaattcatctggcctgccattcagtcctcagctctgtacgaggaccggtatcttcttggcacgagcctcgcacggccctgcatcgcccgcaagcaggtcgaaattgcccagcgcgagggcgcaaaatacgtgtcacatggcgccactggaaagggaaatgatcaggtccggttcgaactgagttgctacagtctcgcacctcaaataaaggtgattgcaccttggagaatgcccgagttttataaccgattcaagggccgcaacgacctgatggaatatgccaagcaacacggaatccccatcccagtgactcccaagaatccatggtccatggatgagaatctcatgcatattagctacgaagccggcattctggagaacccaaagaaccaggcccccccaggactctacacgaaaactcaggacccagcaaaggcacccaatactcccgacattctcgagatcgagttcaaaaagggggtgccggtcaaggttaccaatgttaaggacggcacgacccatcagacatctctagagctttttatgtatctgaacgaggtggccggcaaacatggcgtggggcggattgacatcgtggagaacagattcatcgggatgaaatctagggggatttacgagacccctgcagggaccatcctttatcacgctcacctcgacatagaagctttcaccatggaccgggaggtgagaaagattaagcagggactgggcctgaaattcgccgaactggtgtatacaggcttttggcactctccggagtgtgaatttgtgagacactgcattgccaagtcccaggagcgcgtggaggggaaggtccaggtgtcagtcctcaagggccaggtatatatactgggccgcgaaagtcccctctccctctacaatgaagaactggtgagcatgaatgtgcaaggagactatgagcctactgacgctacgggatttatcaatattaattcgctgaggctaaaagagtatcaccgcctgcagtctaaagtgaccgcaaagtag

SEQ ID NO: 2356 - DNA, 510 bp, Artificial Sequence
  Description of Artificial Sequence: Synthetic coding sequence
gaacctggaccactccagcttatggtcgtggctgaggcccagggcggcaaacatggtgtcggtcgcattgacatcgtagagaatagattcattggaatgaagagtcggggcatctatgaaacccccgccgggactatcctgtatcacgcccatttggacatcgaggcttttacaatggaccgagaggtgcggaagatcaaacaaggactgggccttaagtttgctgagctagtatacactgggttttggcatagtccagagtgtgagttcgtgagacattgcattgccaagagccaggaaagagttgaaggtaaggtccaggtgagtgtactaaagggccaagtgtatatcctgggcagagaaagtccattgagtttatacaatgaggaattggttagtatgaacgtccagggggattatgagccaaccgacgctaccggattcatcaacatcaactctttgagattgaaagagtatcatagacttcagagcaaggtgaccgccaagtag

SEQ ID NO: 2357 - DNA, 1239 bp, Artificial Sequence
  Description of Artificial Sequence: Synthetic coding sequence
atgagttcaaagggcagcgttgttctggcgtactcgggaggtcttgacacaagctgcattctggtgtggctgaaggagcaggggtatgacgtcatcgcttatctggcaaatatcgggcagaaagaagacttcgaagaggcgcggaaaaaggccctgaagctcggcgctaagaaggtgtttatcgaggacgttagtcgcgagtttgtggaggagtttatatggcccgcgatccagtccagcgcactgtacgaagatcggtacttgttgggaaccagcctggcgcggccttgtatcgcccgtaagcaggtggagattgcgcaacgggagggcgccaagtatgtttctcatggagccactgggaagggtaatgatcaggtccgcttcgaattgtcatgttactcgctggcaccacagatcaaggtgatcgccccttggagaatgccagagttctacaatcgattcaagggcagaaatgacttgatggagtacgccaagcaacatggcatacctattccagtcacgcccaaaaatccctggtccatggatgagaatttgatgcacatttcgtacgaggcaggcatcctcgaaaatcctaaaaatcaggcacctcccggactctataccaaaacgcaggaccctgccaaagctcccaacaccccagacatcctcgagatagagttcaagaaaggggtacctgttaaagtgacaaacgtaaaggacggaacaacccatcaaacctccctcgagcttttcatgtaccttaacgaagtagccggtaagcatggcgtgggtaggatcgatatcgtcgagaaccggtttatagggatgaagtcaaggggcatctacgagacccctgctggcactatcttgtatcacgcgcaccttgatattgaagcttttacaatggacagagaagtccggaagatcaaacaggggctcgggcttaagtttgccgaactcgtttacacggggttctggcactcaccggagtgcgaattcgtgcgtcattgtattgcaaagtctcaagaaagggttgagggtaaggtgcaggtcagtgtgcttaagggtcaagtgtatattctgggtcgggaatctcctctcagcctgtataacgaggagcttgttagcatgaacgttcaaggcgattacgagcctacagacgcaaccggtttcatcaacatcaattcactcagattgaaggagtaccacagactgcaatccaaggtaacggccaagtag

SEQ ID NO: 2358 - DNA, 1239 bp, Artificial Sequence
  Description of Artificial Sequence: Synthetic coding sequence
atgagcagtaaaggcagtgtggtcctagcatactctggtggattggatactagttgtattctcgtttggctgaaagagcagggctacgatgtcatcgcctacctggccaacataggccagaaggaggacttcgaggaggccagaaaaaaggccctcaaattaggagcaaaaaaagtgtttatcgaagacgtgtccagagagttcgtggaggagttcatttggcccgcaatccagtccagcgctctttatgaggatcgttacctactcggaacttcactggcccggccttgcatcgcacgcaagcaagtagagatcgcacagcgagagggcgccaaatatgtatctcacggagccaccggtaagggtaatgaccaggttcgattcgagctatcttgttactccttagcaccccagatcaaggttatagccccatggaggatgcctgaattttacaaccgtttcaagggccgaaacgatctgatggagtacgcaaaacagcatgggattccaatcccagtcacccccaaaaacccctggtccatggacgagaacctgatgcatataagttacgaggcgggaatcttggaaaacccaaaaaaccaagctcctcccgggctttacaccaaaacccaagatcccgctaaagctcccaatactcctgacatactcgagatcgagtttaaaaagggtgtgccagtgaaagttaccaacgtgaaggatggcacgacacaccaaaccagtcttgaactcttcatgtacctcaacgaggtcgcgggaaagcatggcgtgggcagaattgacatagtggaaaaccgtttcattggcatgaaaagccggggaatatacgaaacccccgccggaacgattctgtaccacgcacacctggacatagaggccttcactatggaccgagaggtgaggaagattaagcagggactgggcctgaaattcgcggaacttgtatataccggtttctggcattcccctgaatgcgagtttgtccgtcactgcatcgcgaaaagtcaagagagggtcgaggggaaagttcaagtaagcgtgctgaaaggccaggtgtacattttaggccgcgagtctccgctgtccctgtacaatgaagaacttgtgtctatgaatgtgcagggggattacgaacccacagacgctaccggcttcatcaacatcaattccctcagactaaaggaataccatcgcttgcagtctaaagtcacggctaagtag

SEQ ID NO: 2359 - DNA, 597 bp, Artificial Sequence
  Description of Artificial Sequence: Synthetic coding sequence
atgtcctctaaaggcagcgtcgtgctggcttacagcggaggtctcgacacaagttgtattctcgtatggctgaaggagcagggctatgatgtcattgcctatctggccaacatcggccaaaaagaagattttgaggaagccaggaagaaagctctgaagttgggggcaaagaaggtcttcatcgaagacgtgagtcgagagttcgtggaggagttcatctggccggctattcaatcatcagcgttgtacgaggaccggtacctgctgggtaccagcttggcgcggccttgtatagccaggaagcaggttgagattgcacaacgggaaggcgcaaaatacgtgagccacggcgccaccggaaagggtaacgaccaggtacgcttcgaattgtcttgctactccttggccccacagatcaaagttattgcgccgtggaggatgcctgaattctataaccgttttaaagggagaaacgatctgatggagtatgctaagcagcatggcattcctatccccgtgacgcccaagaacccatggagcatggatgagaacctaatgcacatttcctacgaagccggcatcctggagaacccatag

SEQ ID NO: 2360 - DNA, 540 bp, Artificial Sequence
  Description of Artificial Sequence: Synthetic coding sequence
atgtcctcaaagggctcagtggtgctagcctattcaggcgggttagacacctcatgcatactggtttggctgaaagagcagggctatgatgttatcgcctacttagcaaatatcggccagaaggaagattttgaggaggccagaaaaaaagccctcaagttgggtgctaagaaggtgttcatcgaggacgtcagtcgtgaattcgttgaggagttcatctggcccgccatccagtcttccgccttgtacgaagaccggtacctgttaggcactagcttagcccggccttgcattgcgagaaagcaggtggagattgcccagcgggagggcgcaaagtacgtgagccatggtgcaactggtaaagttattgctccatggcgaatgccagagttctataacaggttcaagggaaggaatgacttaatggagtatgctaaacagcacggcattcccatcccagtaaccccgaagaatccgtggagcatggacgagaatctcatgcatatctcttatgaggccggcatactagaaaacccctag

SEQ ID NO: 2361 - DNA, 663 bp, Artificial Sequence
  Description of Artificial Sequence: Synthetic coding sequence
atggaacttgggctgggcgggctgtctactctgagtcactgcccctggccaagacagcagcctgcattgtggcccacattggctgcactcgccctactttcttcagttgccgaagcgagtttggggtcagctcctcggagcccagccccaagggagggtcctccccccgtgctcgcgtcccctgctggacacctaccgggcggtaggaccgcacgttggtgctccgggagggcacggcggcctcctccccagcccagccgccccgctccaccacctcctgccccaccttctgcgctcccacgaggaggcagagcagcaagagcaggaggaccgggctccagagctcgcgccgccggagcccgggggtgtcgtctgagaagtcagctcgtgccggtgagggcattagggctcgggcatcgttccgacgagctggtgaggttccgattctgttcggggtcctgcaggcgggcaagaagtcctcacgatttatccctggcatcacttctgggcgcaggagccctgagaccacccccagggagcagacctgtctcccagccctgctgtcgcccaacgagatacgaggctgtgagtttcatggacgtaaattcgacctggcgaaccgtagaccggctgtctgccaccgcgtgtggttgcttgggttag

SEQ ID NO: 2362 - DNA, 663 bp, Artificial Sequence
  Description of Artificial Sequence: Synthetic coding sequence
atggagctcggtctcggcggtctcagcacactgtcacactgcccatggccccgacaacagccagccttgtggccaacgcttgccgctttggcgcttctgtcttccgtggccgaagctagtctgggatctgccccacgcagtcctgcacctagagagggaccaccacctgtgctggcttccccagcagggcatctgcctgggggtaggacagcccgctggtgttcaggtagagcacgtaggccgcctccccagccctcccgacctgctccgcctccccccgccccaccgagcgctttgcccagaggtggccgggcagcccgggcaggggggccaggctctagggcccgagctgctggagctcgtggatgtagattaaggtcccagctggtcccagtgcgagccctcggactgggccatagaagcgatgagcttgttcgctttcgtttctgttccggctcatgcagacgcgctagatcaccacatgatctgagcctggcaagtctgttgggggctggggccttacgcccaccccctggctctaggccagtcagtcaaccatgctgtcgtcctacacgttacgaagcagtgagtttcatggacgtgaactccacttggcgtactgtagaccgtttaagtgccaccgcgtgcgggtgtctggggtag

SEQ ID NO: 2363 - DNA, 687 bp, Artificial Sequence
  Description of Artificial Sequence: Synthetic coding sequence
atggaactgggcctcgggggcctttccaccctgtcacattgtccgtggccccggcagcaagccccactgggccttagcgctcagccagctttatggcctacattggccgccctggccctgctgagctcagtagcagaggctagtttgggttccgcccctcggtctcctgcaccaagagaagggccaccacccgtgctcgcttctccagccggacacctgccgggtggccgcaccgccaggtggtgttccgggcgtgccaggagacctcccccacaaccctctcgccctgcacctcccccaccagcacctccatcggccctccctcgaggagggagagctgctcgagccggtggaccggggagccgagctagagcagccggcgcccgaggctgtagactgcgttcccagctagtccccgtacgggccctcggcctcggtcatagatccgatgagctggtgcgtttccgcttctgcagcggctcctgccgcagagctcgtagcccgcacgatctgagcttggcctccctcctgggcgccggcgccctgcggcctccccccggaagtagacccgtcagtcagccttgctgtcgacctacaagatatgaggcagtctccttcatggatgtgaactccacatggcgaaccgtcgacaggttgtcagcgaccgcatgtggatgtttgggctag

SEQ ID NO: 2364 - DNA, 201 bp, Artificial Sequence
  Description of Artificial Sequence: Synthetic coding sequence
atggagctgggcctaggagggctgtctacactgtctcactgtccctggcctagacaacagcctgctctgtggccaacgctcgcagcgctggctctgctgtcaagcgtggcggaggccagtctgggcagcgcccctaggtcacccgcacctcgagaagggcctccaccagttctagcctcacccgccggccatttaccctag

SEQ ID NO: 2365 - DNA, 270 bp, Artificial Sequence
  Description of Artificial Sequence: Synthetic coding sequence
atggagctgggcttgggcggtctgtccaccttaagtcattgtccctggcctcgacaacaggcccccctgggcctgagcgcacaaccggcgttatggcccaccttagccgcactcgcactcttatcctccgtagcggaggccagcctaggttctgccccacgatcacccgcccctagagaggggccccccccggtgctcgcgagcccagccgggcatctgccgggcggccgcacagctcggtggtgctctgggagagcaaggcggccctag

SEQ ID NO: 2366 - DNA, 201 bp, Artificial Sequence
  Description of Artificial Sequence: Synthetic coding sequence
atggaactgggactgggaggattgtcgaccttatcacactgcccctggccccgtcaacagcctgccctgtggcccactctggccgcactggcccttctttcctcggtcgctgaagcctcactcgggtctgccccgcggtcacctgccccaagagagggcccaccaccagttctcgcgtctcctgcgggccaccttccctag

SEQ ID NO: 2367 - DNA, 270 bp, Artificial Sequence
  Description of Artificial Sequence: Synthetic coding sequence
atggagcttgggctgggaggccttagcactctgagccattgtccctggccccgtcagcaggcaccactgggtttaagcgcacagccagccctctggcccacccttgccgctttggccctgctgagcagcgtagccgaggccagtctgggcagtgctccacgaagccctgcccccagggaaggccctcctccagtccttgcctcccctgctggccacttacctggcggtcgaaccgcccgatggtgtagcgggagggcgcgtcgcccttag

SEQ ID NO: 2368 - DNA, 687 bp, Artificial Sequence
  Description of Artificial Sequence: Synthetic coding sequence
atggaactcgggttaggcgggctgagcaccctgtcccattgcccatggcccaggcaacaggcgcccctcggactctcggcccaaccagcactctggcctactttggccgctcttgctttactgtcatcagtggcagaagcctcactggggtccgccccacgtagtcctgctccccgcgaaggccctccacctgtgttggccagccccgctggccacctgcctggcggtcgcactgccaggtggtgttccgggcgagcacgcagaccaccccctcagccttctcgtcccgccccaccccctccggcccccccatccgctctgccgcggggtgggcgagctgcgcgggccgggggccctgggtcaagagcccgcgcagcaggcgcccggggctgtagactgcgctcccaacttgtcccagtgagagcccttgggctggggcaccggtccgatgagttggtgcggtttaggttctgctcaggaagttgccgacgcgctaggtccccccacgatttgagcctggcctcactgctgggggcaggggctctgaggcctcccccaggatcccgtcccgtgtcacagccatgctgccgacccacacggtacgaagcagtttcctttatggatgtgaactctacctggcggactgttgatcggctgtcagccaccgcctgtggctgtcttggctag

SEQ ID NO: 2369 - DNA, 1602 bp, Artificial Sequence
  Description of Artificial Sequence: Synthetic coding sequence
atggggcctaggggcgctgcgagcttgcctcgcggacccggcccccgtcggctgctgctacccgttgtgctcccattgctgctcctgttactccttgctccacccgggtccggcgccggcgccagtcggccaccgcatctggtttttctcctcgctgacgacctcggctggaatgacgtaggcttccatggcagtagaattcgtactccgcacttggacgcactggcggccgggggcgtgctgctcgataattactatacacaacccctctgcaccccaagccgctctcagctgctgaccggaaggtatcagatcagaaccgggctgcagcaccaaataatttggccctgtcagccaagttgtgtccctctcgacgagaagttgttgcctcagttacttaaagaggccggatacactacccatatggtgggcaaatggcacttgggcatgtacaggaaagagtgcctaccaacaagaagaggtttcgacacctatttcggctacttattaggcagtgaggactattactcacacgaaagatgtacactcatcgatgccttgaatgtcacaagatgtgctctcgatttccgcgatggtgaggaagtggcaaccggatacaagaatatgtattctactaacatctttacaaaaagagctatcgcactgattacgaaccacccacccgagaaacccctgtttctctacctcgccctacagtccgtacacgaaccactccaggttccagaagaatacctgaaaccctatgacttcatccaggataaaaacaggcatcattatgccggtatggtctcattgatggacgaagctgtaggcaatgtcacagcagctctgaagagctccgggttgtggaacaatactgtcttcattttcagtaccgacaacggcggccaaactctggctggcgggaacaattggcccctgagggggcggaagtggtcgctgtgggagggaggggttagaggagtgggatttgtcgctagtccactcttaaagcagaagggcgtcaagaatcgtgaactgatacatatttctgattggctgcctactctagttaagctggctagggggcacaccaacgggactaagcctctggatggctttgacgtatggaagacaatttccgaaggttcaccaagccctagaatagaactgctgcataatattgaccctaacttcgtggattcttccccgtgccctcgcaattccatggctcctgccaaagatgattcgtctctgcccgagtactctgcctttaatacatcagtgcacgccgcaattaggcatggcaactggaagctgctcaccggatatccagggtgcgggtactggttccccccgccaagccaatataatgtgagcgagataccgagcagcgaccctcccactaaaacactgtggctgttcgatatcgatagggacccagaagaaagacatgacctcagccgggagtatccacacatagtaactaagctgctgtcccggctgcagttttatcataaacactctgtgcccgtgtatttccccgcccaagacccccggtgcgatcctaaggctaccggggtgtggggtccttggatgtag

SEQ ID NO: 2370 - DNA, 1602 bp, Artificial Sequence
  Description of Artificial Sequence: Synthetic coding sequence
atgggcccccggggggcagcctctttgcccaggggacccggaccgaggcggcttttgcttccagtcgtgctaccgttactgctcctattgctgcttgccccacccggaagtggcgcgggcgcttcgcgcccaccccacttggtattcctgttagccgacgacctggggtggaacgatgtgggctttcatgggtctcggatcaggactcctcacctcgacgcactggcggctggaggcgtgctcttggataattactatacacaaccgctctgtaccccctcaagaagccaacttttgacaggccgataccaaattcgcacgggcttgcaacaccaaatcatctggccttgtcaacccagctgcgtgcctctcgacgagaaactgctgccccagctgctaaaggaagccggatatactacccatatggtcggcaagtggcacctgggaatgtacaggaaggagtgtttacccacacgacgcggatttgatacatactttggatatctgttgggctcagaagattattatagccacgagaggtgtacccttattgatgccctgaatgtcacgcgctgtgctctggacttcagggacggcgaggaagtggcaacaggttacaaaaacatgtatagcaccaacattttcacaaagcgtgcaatcgctctgatcacaaatcaccccccagagaaacctcttttcctttatctggcactgcagtctgtgcatgagcccttacaagtccctgaggaatatcttaaaccctacgacttcatccaggataagaacagacaccattatgcagggatggtttccctaatggatgaagccgtgggcaacgtaaccgctgctctgaagtccagcggcctttggaacaacaccgtttttattttctctacggacaacggcggtcagactttggcaggcgggaataactggcctctcagaggacggaagtggtctctgtgggagggcggggttcgaggggtgggatttgtggcctcacctctattgaagcagaaaggggtgaaaaatcgcgaactgatccacatctccgactggctccctactttggtgaagctggccagaggccataccaacggtacaaaaccactggacggtttcgatgtatggaaaactatctcggagggctcaccttcccccagaattgagcttctgcacaacatagatcctaactttgtggatagcagtccctgtccaagaaatagcatggccccagccaaggatgactcttctctgccagagtatagtgcctttaatacctcagtccacgccgccatccgacacggcaactggaagctgctgaccggttacccaggttgcggttattggtttcctcctcctagtcagtataatgtttcagagatcccctcaagcgaccctcctactaagacactttggctgttcgatattgatcgcgacccggaggaacgccatgacctcagccgcgaatatccacatatcgtgaccaaactactaagccgcctccagttttaccataaacattccgtgccggtttacttccctgcccaggacccaaggtgtgaccctaaggccactggagtctgggggccgtggatgtag

SEQ ID NO: 2371 - DNA, 1242 bp, Artificial Sequence
  Description of Artificial Sequence: Synthetic coding sequence
atgggtccacggggtgctgctagcctgccaagagggcccggcccccggcgactattgctccctgtggtcctccctttactgctgcttctgctgcttgccccccccggaagcggggccggcgcttcacggccaccacatctggtgtttttgctcgccgatgacctggggtggaacgacgttggcttccacggttctagaataagaactcctcacctggatgcattagctgccgggggggtcctgctggataactactatactcagcccctgtgcaccccgtcacgcagccagctgctcacgggaaggtatcagattcggactggacttcaacatcagattatttggccttgccagccttcatgtgtccctctggatgagaagctcctgcctcaacttctgaaggaagctggatacaccacacatatggtaggaaagtggcatcttggaatgtaccggaaggagtgccttcccactcgccgcggctttgacacctattttggctacctgctgggatccgaggattattatagccacgagcggtgtaccctaatcgatgctttgaacgtgaccagatgcgccctggatttcagagatggtgaggaggtcgcaactgggtacaagaacatgtactccaccaatatttttacgaagagggctattgctctgataaccaaccatcccccggaaaagcccctttttctgtacctggcactgcagagcgtgcatgaaccccttcaggtgcccgaagagtatttgaagccatatgacttcatacaggataagaataggcaccactatgccggcatggtaagcctcatggacgaggccgtgggcaatgtgacagcagccctgaaaagctccggattgtggaataacacagtcttcatcttctccaccgataatggcggacagacgctggccggaggcaacaactggccactgcgcggacgcaaatggtctctttgggaaggtggagtaaggggcgtcggatttgttgcttcaccgctgctgaagcaaaagggcgtgaagaacagggaattgatacacatttcggattggctccccacccttgtgaaacttgcccggggccacaccaacgggacaaaacctctggacggttttgacgtttggaaaactatttctgagggcagtccatctcctagaatagagctgttacacaacattgaccctaacttcgtagattcatccccctactggcccgaatgctccttgctcctctag

SEQ ID NO: 2372 - DNA, 138 bp, Artificial Sequence
  Description of Artificial Sequence: Synthetic coding sequence
atgggtccccgtggggccgcctccctacctcgtggtcctggacctcgccgcctgctgctgccagtggtcctgcccctgctcctcttgttgctcctggctccccctgggtcgggagctggagcctcgcgacccccctag

SEQ ID NO: 2373 - DNA, 1788 bp, Artificial Sequence
  Description of Artificial Sequence: Synthetic coding sequence
atggcaggcccaagtccccctcttcgagctggcgtggggagacgacttctaggggttgcacatccggatctgaggccatgtttatgcggcgaattacaggtggagggaggcccaggccccgtgcccggaatgttacggacttgctacgtcaggtctccctggagacgtggaccctcatcagccaggggtgagcagtccggaagcggtcacctcgaacaagaggaggtgcagtcaggcagcctgttgtttcgcttgctcctttttttgtccagatctccagccagtagaaatcagaggatcttgtatacagtgctggaatgtcagccactattcgattcaagtgatatgacaattgcagaatgggtgtgtctggcacagaccattaagcgacactacgagcagtaccacggcttcgttgtgatacacggcacagacaccatggcattcgctgcatccatgttaagctttatgttagagaatttgcagaagacagtaatactcacaggcgcccaggtgcccattcacgccttatggagcgacggccgcgagaacctgctgggtgcactgttgatggctggtcaatatgtgatcccagaagtatgcttgttcttccaaaaccagttatttagaggcaaccgagccacaaaggttgatgcaagaaggtttgccgccttttgtagtccgaacctgctgcccctggctacagtgggcgcggacataaccataaacagagaactggtccgaaaggtcgacggaaaggcaggactagtagtgcatagcagtatggagcaagacgtcggcctcctaagactttacccaggaataccggcagccttggtgagagcttttttgcagcctccattgaagggagtcgtcatggaaacatttgggtcgggaaacgggcccaccaagcctgatctattacaggaactgagggtcgcaacagagagggggctcgtgatcgtgaattgcacccattgcctgcagggagctgtgaccaccgactacgcagccggtatggcgatggcgggagccggggtaataagcggcttcgatatgacctccgaggccgcgcttgcgaaactgtcctacgtcctcgggcaacccggtctgagcctggatgtgcggaaagagctgctcacaaaggatctgcggggtgagatgacccccccatctgtggaggagcggaggccttctctccagggaaacactctggggggcggagtgagctggctgctcagcctgagcggctcacaggaagctgatgccctgcgcaatgctctggttccttcgttggcttgtgccgcagcccatgctggtgacgtggaagccttgcaagccctcgtcgagcttgggtctgatctcggtttagtggattttaacggccaaacacctctgcatgcagcagcgcgcggtgggcatacagaagctgttacaatgctccttcagaggggcgtcgatgtgaacacaagagataccgatggcttctcccctctgcttctggctgtcagaggccgtcaccctggcgtcattggcttgctcagggaggccggcgcaagtctaagcacgcaggagctggaagaagcgggtaccgagctttgccgactcgcctacagagccgatttggaaggcttacaggtgtggtggcaggcgggagcggacttgggccagcctggctacgacgggcactcagctctgcacgttgccgaggctgctgggaatctcgcggtggttgcgttcctgcagtcattggagggagcagtgggagctcaggcgccttgtccctag

SEQ ID NO: 2374 - DNA, 1740 bp, Artificial Sequence
  Description of Artificial Sequence: Synthetic coding sequence
atggctagggcggttggtccggagaggcgactcctggctgtgtataccgggggcactattggaatgaggtctgagttgggggttctggtgcctggcaccggtctagccgcaattctacggacactgcccatgtttcacgacgaggaacacgcccgcgccagaggcctgagcgaggataccctcgtgctccctccagcgagccggaatcagcgaatcttgtataccgtgcttgaatgccaaccactgttcgactcatctgacatgactatcgccgagtgggtgtgtctggcccagaccattaagcgacactatgagcagtatcacgggtttgtcgtaatacacgggacggataccatggcctttgctgcgtctatgttgtcattcatgctagagaacttgcagaaaaccgtaattttaacaggcgcacaggtgcccatacacgccctttggtccgatggaagggagaacctactgggagccctccttatggcgggacagtacgtcatcccagaagtgtgtctgttttttcagaaccagctgttcagagggaatcgagccacaaaggtcgacgccaggcgatttgcagccttttgtagcccgaacctcctcccattagcgaccgtaggagcggatatcacaattaaccgggaattggtgcggaaggtcgatggaaaggcggggctggttgtacattcatcaatggagcaagatgtgggcctgttaagactttaccccggaatccctgccgccctggtgcgcgccttcctgcagcctcctctcaagggggtcgtaatggaaactttcggcagtggcaacggaccaaccaagccagatctgctccaggaactccgcgtggcgacagaacgcggactcgtcatcgtcaattgtactcactgcttacagggagctgtgaccaccgactatgcagccggaatggccatggccggcgccggcgtgattagtggcttcgatatgacaagtgaagctgcactagcgaagctcagctacgtcctgggccagcccgggttatctttggacgtgagaaaggagctcctcactaaggatttgcgaggtgaaatgaccccaccatctgtcgaagaacggcgcccatcactacaggggaatacactgggcggtggggtttcctggctgctgagcttgagcggctcccaggaagcagacgccttgcggaatgccctggtgccatccctggcctgtgccgcagcacacgcgggggacgtggaggcactgcaggccctagttgaactgggatctgacttaggtctggtagacttcaatgggcagacaccactgcacgcggctgccaggggtgggcacacggaagcagtcacaatgctcctccaacgaggcgtcgatgtgaatacccgtgacaccgatggattttctccactcctgctggccgttagaggcaggcaccctggggtgattggcctgttgagggaggccggagcaagtcttagtacgcaggagctggaggaagccggaacggaattgtgtcggctggcttaccgcgcagacttggaaggcctccaggtgtggtggcaggcaggggcagacttaggtcagcctgggtacgacggtcactctgcgttacatgtagctgaggctgccggcaatctggctgtggtggcgtttctccaatcgctagagggagcagtgggcgcccaagctccgtgccccgagccatcctgcttccaggaggtgctgcccggcgtgtag

SEQ ID NO: 2375 - DNA, 423 bp, Artificial Sequence
  Description of Artificial Sequence: Synthetic coding sequence
gccgctgcgaggggagggcacacagaggcagtaacgatgcttctccaacggggagtggacgtgaataccagggatactgacggattctctccacttcttctggccgttcgtgggagacatcccggtgtgatcggtctgctcagggaagccggcgcaagccttagcactcaggagcttgaggaggccgggactgaattgtgtcggctggcataccgagctgaccttgagggactgcaagtgtggtggcaggcaggggctgatctagggcagccggggtacgatggacactccgcacttcacgtagcggaggccgctgggaatctggccgtggtggccttcttgcagtcgttagagggggcagtgggagcccaggcaccctgccctgagccatcatgttttcaagaggtgcttccaggggtgtag

SEQ ID NO: 2376 - DNA, 1722 bp, Artificial Sequence
  Description of Artificial Sequence: Synthetic coding sequence
atggcccgggccgtgggcccagaacggcggctcctagcagtgtatactgggggtaccatcgggatgcgctctgagcttggagtgctggtccctggtacagggctcgctgctatactccggaccctgcccatgtttcatgacgaggaacacgctagggcccgaggcctgtctgaagatactcttgtcctcccaccagcgagcaggaaccaaaggattttatacacagtcctcgaatgccagcccctgtttgacagcagtgacatgacaatcgctgagtgggtgtgtctggcgcaaactattaagcggcattatgaacagtatcatggctttgtggtgattcacggtacagatacaatggcatttgccgctagcatgttgtccttcatgcttgaaaacctgcaaaaaactgtgattctaaccggagcgcaggtccccattcacgccttatggagtgatgggcgggagaacctgttgggggcactgcttatggcagggcaatacgttattcctgaggtgtgtctgtttttccagaatcaactcttccgcggaaatagggcaacaaaggtggacgcccgtcgtttcgccgctttttgttctcctaatctactgcctttggcaaccgtcggggccgacattacgatcaaccgagaattggtgagaaaggtggacgggaaggccggactggtagtccacagcagtatggagcaggacgtagggcttctgcgcctctaccccggcatccccgctgcgctagtgcgcgcctttctgcaacccccccttaagggagtggtgatggaaacctttggctccggcaacggacccacaaagccagacctcttacaggaactccgggttgccactgagcgtggcctggtgatcgtcaactgcacccattgtttgcagggggctgtgactaccgattacgcagccgggatggccatggcaggagctggtgtgataagcggatttgacatgacaagcgaggccgctctggctaaactctcctacgttctggggcagcccgggctcagtctagacgtacggaaggaactgctcactaaagacctccgtggtgagatgacccctccatcagttgaggagcggagaccaagtcttcaaggcaatacacttggcgggggcgtgtcttggcttctttctctcagcggttctcaagaggccgacgcactgaggaatgccctggtgccttctcttgcttgcgccgcggcccacgcgggtgacgtcgaagccttacaagctctggtggaactcggttcagacctgggccttgtggactttaatggccagacccccctgcacgccgccgcgcgtgggggacacactgaagcagttacgatgctgctacaaaggggcgtcgacgtaaatacacgcgacacagacggattttcgccgctgctcctcgcagtcaggggtcgtcatcccggcgttatcggactgctccgggaggctggcgcatcactgtcaacacaggaactcgaggaagccggtacagaactctgtcgcctggcttatagagctgacctggaaggcctgcaggtatggtggcaggccggtgcagatctcggccagcctggttacgacggccacagcgctctgcacgtcgccgaagctgcgggcaatctagctgtcgtggctttcctccaatccctcgagggagcagttggggcccaggcgccctgcccagaagttctgcccggggtatag

SEQ ID NO: 2377 - DNA, 942 bp, Artificial Sequence
  Description of Artificial Sequence: Synthetic coding sequence
atgacctcctgccacatcgccgaggaacacattcagaaggtggccatatttggcggcacccatgggaacgagttaaccggcgtatttctggttaagcactggctagaaaacggggctgagattcagcgcaccggcctcgaagtgaagccttttatcacaaacccccgtgccgtgaagaaatgcactagatacatcgactgtgatttgaacagaatcttcgacctcgaaaacctcggcaagaaaatgtctgaggatcttccgtatgaggtcagacgcgctcaagaaatcaatcacctgttcgggccaaaggactctgaggacagctacgatattatctttgatctgcacaacactaccagcaatatgggatgcacactgatccttgaagattcccggaataacttcctgattcagatgttccactatataaagacctccctagcccctctcccatgctacgtgtacttaatcgaacatccctcactgaagtatgccaccactagaagcattgcaaagtatccggtgggtatcgaggtagggccccagcctcagggtgttttgcgcgcggatattcttgaccaaatgagaaagatgattaagcatgctctcgatttcattcaccactttaatgagggcaaggagttccccccctgtgccattgaggtgtataaaatcattgagaaagtggactaccccagggatgagaatggagagatcgctgcaattattcaccccaacctgcaggaccaagactggaaaccccttcaccctggggatcccatgttcctcaccctggatggcaaaacaatcccactcggaggtgactgtacagtatatcctgtattcgtcaatgaggccgcttattacgagaagaaagaggcattcgcaaaaacgacaaagctgaccctcaacgcaaaatctattagatgctgcctacactag

SEQ ID NO: 2378 - DNA, 942 bp, Artificial Sequence
  Description of Artificial Sequence: Synthetic coding sequence
atgacctcctgccacatagccgaggagcatattcagaaggtggccatcttcggcggtactcatggcaacgagcttaccggcgtgttcttagtgaagcactggttagagaacggggcagaaattcagagaaccggcctagaggtgaagcctttcatcacaaatccccgggctgtgaagaagtgcacccgatacattgactgtgacctcaacaggatctttgatctggagaacctgggtaagaaaatgagtgaagacttgccttacgaggttaggagggcccaggagattaaccatctgttcggacctaaggatagcgaggatagctatgatatcatttttgatttacataacacaactagcaacatggggtgcactttgatcctcgaagatagccgtaataacttcctgattcaaatgtttcattacattaagacaagtctggctccattgccatgttatgtctacttaatcgagcatccgtccttgaaatacgctaccacaaggtcaattgccaagtatcctgtgggcattgaggtggggcctcaacctcagggcgtactcagggcggacattctggatcagatgcgaaaaatgatcaagcacgcactcgactttatccatcactttaacgaaggcaaggaatttcctccatgcgcaatcgaggtttataaaatcatcgagaaggtggattaccctagagacgagaatggagagattgccgccatcatccaccccaatctacaggaccaggactggaagccattgcaccctggcgatcccatgtttctaaccctggacggaaaaactatccccctcgggggcgattgcactgtgtatcctgtcttcgtcaacgaggctgcctactacgagaagaaggaagccttcgctaaaaccactaaactaacactgaatgcaaaatccatcagatgctgtcttcattag

SEQ ID NO: 2379 - DNA, 3756 bp, Artificial Sequence
  Description of Artificial Sequence: Synthetic coding sequence
atgtcaaccgaacgcgactctgagacaacgttcgacgaggactctcagcccaatgatgaagtggtcccctattctgacgacgagaccgaagatgagctcgatgatcagggatcagccgtagagcccgaacaaaaccgcgtcaacagggaggccgaagagaatagggaaccctttcgcaaagaatgtacatggcaggttaaggccaacgatcggaaatatcacgagcagccacatttcatgaacactaaattcctatgcatcaaggaaagtaagtacgcaaataacgccataaagacatacaagtacaatgcgttcactttcatacccatgaacctgtttgagcagtttaagagggcagccaatctgtacttcttggccctgttaatcctgcaagccgttcctcagatttcaacactcgcctggtatacgacactggtgcccctgctggtcgtcctgggagtgaccgccattaaagatctcgtggatgatgtggcccgacacaagatggacaaggaaatcaataatcgcacatgcgaggttataaaggatggtagatttaaagtggcaaagtggaaggagattcaagtgggtgatgtcatccggctgaaaaagaatgatttcgtgccagcggatattctgctcctgtctagcagcgagccaaattcgctttgctacgtagagactgcagaattggacggcgagaccaacttgaagtttaaaatgagcttggagattacagaccagtatctgcagagggaggatactcttgctacttttgatggctttatcgaatgcgaggaacctaataaccgcctggataaattcactggaacattgttctggagaaacaccagctttccattagatgctgataagatcttactgcggggttgcgttatccgcaacaccgacttctgtcacggtctcgtgatcttcgccggggccgataccaagatcatgaaaaacagtggtaaaaccagattcaaaagaactaagattgattacttaatgaactacatggtttacactatcttcgtggtactgatccttctctcagccggactcgccatcggccatgcctattgggaggctcaagtgggcaactcctcctggtatctatatgacggcgaggatgacacgcctagctaccgcggatttctgatcttctggggatatataatcgttctcaacacgatggtgcctatatccttgtatgttagtgttgaagtgatacggctgggacagtcacatttcattaactgggacctacagatgtactatgcagaaaaagacaccccggctaaggcccgcacgactaccctgaatgaacagctcgggcagattcactacatctttagcgacaagactggcactttgacacagaacattatgaccttcaaaaaatgttgcatcaatggccaaatttatggggatcaccgagatgcgagccaacacaaccacaacaagatcgagcaggtggacttttcatggaacacctacgcagacggaaaactggctttctacgaccactacctgatcgaacagatccagtcgggtaaagagccggaggtgagacagttcttctttcttctggctgtgtgtcatactgttatggtggacaggaccgatgggcaattgaattaccaggccgcgagtcccgacgaaggggcgctcgtgaatgcagcccgaaatttcggctttgcctttctggccaggacacagaatacaatcacaattagtgagctggggacagaacggacctataatgtccttgcaattcttgattttaattctgaccggaaacggatgagcattattgttcggacacctgagggtaatatcaagctctactgtaagggcgccgacacagtgatctacgagaggcttcaccgtatgaacccaaccaaacaagaaactcaagatgctttagacatttttgccaatgagactctgagaactctttgtctgtgctacaaagaaatcgaagagaaggagtttaccgagtggaacaagaagtttatggcggcgtcagtggcttcaaccaaccgagacgaggcgctggataaagtgtatgaggagattgaaaaggacctcattttactgggcgcgacagcaattgaggataagttgcaggatggggtacccgagaccatctcaaagctggctaaggccgacattaaaatttgggtcttgaccggagacaaaaaagagaccgctgaaaatatcggatttgcgtgtgaactcctcactgaggacacaactatctgttacggggaggacattaactcccttttacatgctcgaatggagaaccagcggaatagaggcggcgtttacgccaagttcgcacctccggttcaggagagcttcttcccaccaggaggaaatagagcactgatcatcactggttcttggctgaatgaaatcctcctggaaaagaagacaaaacggaataagattctcaagctgaaattccctagaaccgaggaggagagacgcatgaggacacagtcaaaacgacggttagaggccaagaaggagcagagacagaaaaattttgtggatctggcatgcgaatgctcggctgtgatttgttgccgggtgactcctaagcagaaagccatggttgtggaccttgtgaagcgctacaaaaaggcgataacactcgccataggcgacggtgccaatgacgtgaatatgatcaaaacagcccacatcggcgtggggatctcagggcaggaggggatgcaggctgtcatgtcatcagactactctttcgcccaatttaggtatttgcagcgcctgcttctggtgcatggtaggtggagttatatcagaatgtgcaaattcctgcggtatttcttctacaagaattttgcattcaccctggttcacttttggtactccttcttcaacggttacagtgcccagaccgcttatgaagactggtttattaccctttacaacgtgttgtacacaagtctgccagttctgctaatgggacttctggaccaggatgtgtccgataagctgtccctccgctttcctggactttacatcgtcgggcagcgcgatcttctgttcaactataagcgatttttcgtgtctctgttgcatggagtacttacgtccatgattctgttctttattcctttgggagcttatctacaaaccgtaggacaggacggcgaggccccatccgattatcagagcttcgccgtgactatcgcgagcgcccttgtcattaccgtgaatttccagatcggattggatacctcctactggacatttgtgaatgcgttctcaatattcggatctatcgccctgtattttggcatcatgttcgacttccacagcgcggggattcatgtgttgtttccatctgcattccaattcaccggaacggcttctaacgctctccgacagccctacatttggcttaccataatactggccgtcgcagtatgcctgctacctgttgtagctattagattcttgtccatgacgatctggccctccgagagtgacaaaattcagaagcaccggaaacgcctgaaagccgaggagcagtggcaaagaaggcagcaagtgtttcgtcggggtgtgagtacccggaggtctgcatatgccttctctcatcagagagggtatgccgatctaatttctagtggcagatctattcggaagaaacgctcacccttagacgccattgtggcagacggcaccgccgagtatcggcgaaccggcgatagctag

SEQ ID NO: 2380 - DNA, 3756 bp, Artificial Sequence
  Description of Artificial Sequence: Synthetic coding sequence
atgtccaccgaaagggacagtgaaacgacttttgacgaagacagccagcccaatgatgaagtggtgccgtactcggacgacgaaacggaggacgagctcgacgaccaagggtctgctgtcgagcctgagcaaaatagagttaaccgggaggccgaggaaaaccgcgagccgttccgaaaggaatgtacatggcaagtgaaagcgaacgatagaaagtaccacgagcaaccccactttatgaataccaagttcctctgtattaaggagagcaagtatgccaacaacgccattaagacctataaatacaacgcattcacatttatccccatgaacctgtttgaacagtttaagcgtgcagccaacttgtacttcctggctctgctgatactgcaggccgtccctcagatatctaccctcgcatggtacacgacattggtcccactgctggtcgtgctcggagtgaccgctataaaggacctggttgacgacgtggcgcggcataaaatggataaagaaatcaataaccgaacatgtgaggtcatcaaggacggtaggttcaaggttgctaaatggaaggagatccaggtgggagacgttatccgattaaagaagaacgatttcgttcctgctgacatcctcctactctcaagcagcgaaccaaatagcctgtgttacgtggaaacagccgaattggacggcgaaactaacctcaagtttaaaatgagcctggaaatcacagaccaatacctccagcgggaggacacattggcaacattcgacggtttcattgagtgtgaggagccaaataaccgcctggataagttcactggcacactgttttggcggaatacaagctttccgctggacgccgacaagattctcctgcgcggctgcgtgatccgaaacactgacttttgtcacggattagtgattttcgctggagccgacacaaaaatcatgaaaaactcaggcaagacaagatttaaaagaactaaaattgattaccttatgaattatatggtatacacaatcttcgtggtgctgatcctgttgagcgcgggcttggctattgggcacgcctattgggaggcacaagttggaaactcctcatggtacctgtacgatggtgaggacgacactccaagctacagaggtttccttattttctggggttatattatagtgctgaatacaatggtacctatttctctctatgtgtctgtggaggtcattcggcttggtcagagccacttcattaattgggacttacaaatgtactatgccgaaaaggacacacccgcgaaggctcggaccacaacccttaatgagcagctcgggcaaatacattacatctttagcgacaagacaggcactctcactcaaaacataatgactttcaagaagtgttgtatcaacggccagatttacggtgatcaccgggatgcttcgcagcataaccataataaaattgagcaggtggacttcagctggaacacttatgccgacggaaaactcgctttctatgatcactatctaatcgagcaaatccagagcggaaaagaacccgaggtcagacaattttttttcctactcgccgtgtgccacaccgtgatggttgaccgcactgacggtcaactcaactaccaggccgcctcacctgatgagggcgctcttgtcaatgccgcaaggaacttcggatttgctttcctcgctcgaactcagaatacgattaccatcagcgaattgggaacggaacgcacttacaatgttctggccatcttggatttcaacagcgaccgcaagcgtatgtcaataatcgtcaggacacctgaaggaaacattaaattatattgtaaaggggccgatacagtcatctacgaacgcttgcaccggatgaatcctaccaagcaggagacacaggatgctctggacatcttcgccaatgagaccttgcgtactttgtgcctgtgctacaaggagatcgaggagaaggagtttacagagtggaacaaaaagtttatggcggccagtgttgctagcactaacagagatgaggccctagacaaggtctacgaagaaattgagaaggacttgattcttctgggggccacagctatcgaagacaagctccaagacggcgtccccgaaactatttctaagctcgccaaagccgatatcaagatctgggtgctcacaggagataaaaaagagacagctgaaaatatcgggtttgcgtgtgagctgctcacagaagacaccactatctgttacggagaggatatcaactctctacttcatgcaagaatggaaaatcaacgcaatagaggtggcgtttacgctaaattcgccccccctgttcaggagtccttttttccgcctggaggcaacagagctcttattattacagggtcctggttgaatgagatcctgttagaaaagaaaaccaagcggaataagatcctgaaacttaaatttcctcggacggaagaagagcgtcggatgaggacccagtctaagcgtagactcgaagccaagaaagaacagagacagaaaaattttgttgacctcgcttgcgagtgctccgccgttatctgctgccgggtgacccccaaacaaaaggccatggtcgtggacctggtcaaacgctataaaaaggctataaccctggctatcggggatggtgctaacgatgtcaatatgattaagactgcccacatcggggttggtatcagcggccaggagggtatgcaggccgtaatgtcttcggactactcattcgcccagttcaggtacctgcagcgcctgctgctagtgcacggaaggtggagctacatcaggatgtgtaagtttctccgatattttttttacaaaaattttgcctttacactggtccatttttggtatagtttctttaacggatatagcgcacaaacagcctatgaagactggtttattactctatacaacgttttgtacacttctctgcccgtcctcctgatgggcctgctggatcaggacgtcagcgataagctgagcctgcgattcccaggtctgtacattgtcggacaaagggacttgctgtttaattacaagcgcttctttgtcagcttgctgcacggggtcctgacatcaatgatacttttttttatacccctcggagcttatctccagacagtcggccaggatggagaagcgcccagcgactaccaatcttttgcggttacaatcgcctcggccctcgtgattacagtaaacttccagatcggcctggacacttcttactggacgttcgttaatgcattctcaatctttggttcgattgccttgtacttcggcatcatgttcgacttccactccgctgggatccacgtgttgttcccttcagcctttcaattcacaggcacagccagtaacgcccttagacagccctatatctggttgactattatcctcgcagtggcagtatgcctgttgccggttgtcgcaattaggtttctgagcatgaccatctggccatccgaaagcgataagatccagaagcacaggaagagactgaaggctgaggaacagtggcagagaaggcagcaggtgttcaggcgtggggtgagcactagaaggtctgcctatgctttttcccaccagcgcggctatgctgatctaatctcctccggacggtctattagaaagaaacggtctccactggacgccattgtggctgacggcaccgccgagtacaggcggacaggcgattcatag

SEQ ID NO: 2381 - DNA, 4398 bp, Artificial Sequence
  Description of Artificial Sequence: Synthetic coding sequence
atgccggaacaggaacgtcagatcaccgccagggaaggggccagtcgtaaaatactctccaagctctccttaccaaccagggcatgggagccagcaatgaagaaaagcttcgcttttgataacgtaggctacgagggcggccttgacggactgggtccttcctcccaggtggcaactagtacagttcggattttgggaatgacatgtcagagttgcgtgaagagtatcgaggataggatcagtaacctgaagggaatcattagcatgaaagtatccctggagcaggggtcagccacagtgaagtacgtgccgtctgtcgtctgcctgcagcaagtttgccaccagataggagacatgggtttcgaggctagtatcgcagagggcaaagccgcctcatggccctctcggtctctacctgcacaggaagcggtggttaagttgagggtcgagggaatgacatgccaatcgtgtgtgagtagtatagaaggtaaggtgaggaagctgcagggcgtggtgcgggtgaaagtgtcactgagcaaccaggaggcggtcatcacataccaaccttaccttattcagcccgaggatctacgagaccatgttaatgatatgggctttgaggcagccatcaaatccaaagtggcgccactgtccttgggacccattgatatcgaacgactccaaagcacaaaccccaaaaggccactgagcagtgccaatcagaacttcaacaattccgaaaccctgggtcatcaggggtctcacgtcgttacactgcagttgcgaattgatggaatgcactgcaagagctgtgtcttgaatatcgaagaaaatatcggacagctcctgggcgtgcagtctattcaggtgagtcttgagaataaaacagcccaggtaaagtatgacccaagctgtactagccctgttgccctgcagcgagccattgaagctttaccgccagggaactttaaggtcagccttccagacggcgcagagggttccggcactgaccaccgttcatcaagtagtcatagcccagggagtccaccacggaaccaggtgcaggggacatgctccaccacactcatcgcaattgccggtatgacatgcgcttcgtgtgtgcattctatcgaagggatgatctcacagctagaaggcgttcagcagatttctgtgtccctggctgaaggaaccgctactgtgctctacaatccttccgtaatctcccccgaggagctcagggccgcaatcgaagatatgggatttgaggcgtcagttgtgagtgaaagctgtagcactaaccctctgggcaaccactccgccgggaacagcatggttcaaactacggacggtacaccaacctcggttcaggaggtggctccacatactggccgtctgccagccaatcacgccccagatatcctggcaaagtcgccccagtcaaccagggctgtcgccccacagaagtgcttcttgcaaatcaaaggaatgacctgcgcttcttgtgtgtccaatatagaacgcaacctccaaaaagaagcgggagtgctcagcgtgttggtagccttaatggcagggaaggccgaaattaagtacgaccctgaagtgatccagccactggaaatcgcgcagtttatccaggacctcgggtttgaagcagctgtcatggaggattacgcaggctcagatggcaatatcgagctgacgataacaggaatgacatgcgcctcctgtgtgcataacatagaatctaaactcacccggaccaatggcatcacctatgcttccgtggctctcgctacttcgaaggccctggtgaagttcgaccctgaaattataggtccaagggatatcatcaaaatcatagaggagattgggtttcatgccagtctcgctcaacggaaccctaatgcacaccacctggaccacaagatggaaattaaacagtggaagaaaagcttcctttgtagtctggtgtttggaatccctgtcatggcgctgatgatttacatgctgatccccagcaacgagccccaccagtcaatggtgcttgatcacaacataatcccaggtctgagcatcctcaatttgatcttctttatcctgtgtaccttcgtgcaactgcttggcggctggtacttctacgttcaagcctataagtcgcttcggcatcgctctgctaatatggacgtgttgatagtgttggccaccagtattgcttacgtttactcccttgtcatcctagttgtggccgttgcggaaaaggctgagcgaagtcctgtgaccttcttcgatacacctccgatgctgtttgtctttattgccctggggaggtggctggagcacttagcaaagagcaagaccagcgaggccctggccaagctgatgtccctccaagcaactgaggcaaccgtggttaccctcggcgaagataatttgataattcgggaggaacaggtcccaatggaattggtacagaggggcgacatcgtgaaagtcgttcccggaggtaaatttcccgttgacggcaaggtcctggaggggaacaccatggcagacgagtctttaattaccggcgaagccatgccagtaactaagaagcccggctccaccgtgattgctggttctataaatgcccacggcagcgtactcataaaagctacccatgtcggaaacgacactacactagcccagatagttaagctcgtcgaggaggcgcagatgtctaaagcgcccatccagcagctcgccgaccggttttctggatacttcgtcccatttattattatcatgtccactctaaccctagtagtgtggatcgtgatcggctttatcgacttcggcgtagtccagcgttattttcccaaccccaacaagcacatttcccagacagaagtgattattcggttcgcatttcaaacctccatcactgtgctatgcatagcatgtccgtgtagtcttggcctggccactcccacagccgtgatggtgggcaccggtgtcgcagcccagaacggaatcctcattaagggcggaaagccattagagatggcccacaagatcaagacagtcatgtttgataaaacaggcaccatcacccatggtgtaccacgagtgatgcgagtgttactcttaggggatgtagcgacacttccactgcgtaaagtactagcggtggttggcactgccgaagccagcagcgaacacccactgggagtggcagtcacaaagtactgtaaggaagaacttgggaccgaaactctgggctattgcaccgatttccaagccgttccaggctgcgggattgggtgtaaagttagcaacgtggagggcattctggcccattccgagagaccgctgtcagctccagccagtcacctaaatgaagccggttcactgcctgcagagaaggacgcagtcccccaaaccttcagtgtgctgatcgggaaccgggagtggctacgccgcaatggtcttaccatcagtagtgacgtttccgatgctatgacagaccatgagatgaaaggacaaacagccatacttgtggccatcgatggggtgttgtgcggtatgatcgctattgccgacgctgtgaaacaggaagccgctctcgcagtccacactttgcagtcaatgggtgtggacgtggtcctgatcaccggagacaatagaaagactgcacgggcaatcgcaacgcaggtgggcattaacaaggtgtttgcggaagttcttcccagtcacaaggtggcaaaggttcaagaactacagaataaaggcaaaaaagttgctatggtaggagatggcgtaaatgactcacccgctttagctcaggccgatatgggcgtagcaatcggcaccgggacagatgtggctattgaggcagcagacgttgtcttgatcaggaatgacctgcttgacgttgttgctagtatccatttgagcaaaagaaccgtccgccgcatacgaatcaatttagtgctggccctcatctataacctggttggcattcccatcgctgctggagtgttcatgcctattggcatcgtcctgcagccgtggatgggcagcgctgcgatggctgcgtcatcagtaagcgtagtgttgagcagccttcaattaaaatgttataagaaacccgatctcgagcggtacgaggcacaggcccatggtcacatgaaaccactcactgctagccaggtctccgtccacatcgggatggacgatcggtggagggacagccctcgggctaccccttgggaccaggtctcctatgtcagccaggtgagtctttcaagcttaacttcggacaagccaagtcgacactctgctgctgccgatgacgacggtgataagtggtcgctcctgctgaatgggcgggacgaggaacagtacatctag

SEQ ID NO: 2382 - DNA, 3777 bp, Artificial Sequence
  Description of Artificial Sequence: Synthetic coding sequence
atgcctgaacaggagaggcaaattaccgcccgcgagggtgcctccagaaagattttatctaagctgtccctgcctacacgagcatgggagccagctatgaagaagtcttttgcatttgataatgtgggctacgagggaggcctcgacgggttagggccttcctcccaggtagccacaagtactgtgcggatcctcgggatgacctgccagagttgcgtgaagagtattgaggaccggatttcaaacctcaaaggcataatatcaatgaaagtgtcacttgagcagggaagcgccacagtgaagtacgttcctagtgtcgtctgtctgcaacaagtctgccaccagatcggcgatatgggctttgaagcatctattgctgaaggaaaggcagctagctggccatcgcgatcattacccgctcaagaagccgtggttaagctgcgcgttgaaggcatgacatgtcagtcttgtgtgtcctcaattgaaggaaaggtgaggaagttgcagggcgtggtaagagtcaaagtgagcctgagcaatcaggaggccgttattacttaccaaccatacctcatccagcctgaggacctccgtgatcatgtcaatgacatgggatttgaagcagccatcaaaagcaaggtggccccactcagccttgggcccattgacattgagagattgcagtccacaaatccaaagagacccctgtcgtctgctaatcaaaattttaacaactccgagaccctgggacaccaggggtcccacgtggtaaccctccagctgagaattgatggaatgcactgtaagtcatgcgtgctgaacattgaggaaaatatcggtcagctcctgggcgttcaaagcattcaggtgtcgctggagaataaaaccgctcaggtcaagtatgacccttcctgcacctcgcccgtggcactgcagagggcgattgaggctctacccccaggcaattttaaggtctccttgcccgatggtgctgaagggtcagggactgaccatcgaagctccagttctcacagtcccggcagtccccccaggaatcaggtgcagggtacctgttccaccactctgattgcgatagctgggatgacctgcgcctcctgtgtccactccatcgagggtatgattagccagctggaaggtgtccagcagatcagcgtgtctctcgcagaaggcaccgccactgtcctctataacccatctgtcatctcacctgaagaactacgggcagctatcgaagacatgggattcgaagcgtctgtagtgagtgaatcatgttcgaccaacccactcggtaaccattcagctggcaactcaatggttcagaccacggatggtaccccgacctctgttcaagaagtcgcccctcataccggtcgtctgcccgcaaaccacgcccccgatatcctcgctaagtctccgcagtctactcgagctgtggctccccagaagtgctttctgcagattaaaggcatgacttgcgctagctgtgtgagcaatattgagaggaacctgcagaaggaggccggcgtcctgagcgtgttagtcgcccttatggcaggaaaggccgaaattaagtacgatccggaggtgattcagcctctggagatcgcacagttcatccaggacttgggcttcgaggctgccgtgatggaggattacgcgggcagtgatggtaatattgagctcacaatcaccggtatgacttgtgcctcgtgtgtacacaatatcgagtctaaactgacacgcactaatggaataacctacgcctctgtcgctctggcaaccagcaaggctctcgttaagtttgaccctgagatcatcgggcctagggacattatcaagattattgagagcaagacttctgaggccctcgcaaaattaatgtctctgcaggccactgaggccactgtagtgacactgggcgaggacaacctgatcatcagagaagaacaagtacctatggaactcgtccagaggggggatatcgtgaaagtggtgcccggcggcaagtttcccgtcgatggaaaagttctggagggtaataccatggcggacgagagcctaatcactggcgaagcaatgccagtgactaaaaagcccgggtccaccgtgatcgccggttccatcaatgcccatgggtctgtgctcatcaaggccacccacgtcggcaatgacacaacattggcccagattgtcaagctcgtagaagaagcccaaatgagcaagaacccaaacaagcacatcagccaaactgaagtcatcattaggtttgcttttcaaacatctataactgtgctctgcatcgcatgtccatgttcccttggactggcgacaccgacagccgttatggtggggactggcgtcgccgctcagaatggcattctgataaaggggggaaaaccccttgagatggcacataaaatcaaaacggttatgtttgacaagactggcacaattacccatggcgtgcctagggtaatgagagtgctgctgctgggagacgtggccacacttccattaaggaaagtgttagccgtcgtgggaaccgccgaggccagttctgaacatcctctgggggtggctgttaccaaatactgcaaagaagaattgggaaccgaaacgctgggatactgcacagattttcaggccgtacctgggtgcggaataggatgtaaagtgtccaatgtggaaggcattttggcccactcagagaggcctctttccgcgccagcatcccacctcaacgaagcaggctccctgcccgccgaaaaggatgccgttccccagaccttctcggtgctgatcggcaatagagaatggctgcgaaggaacggtttgaccataagctccgatgtttcagatgctatgaccgatcatgagatgaagggtcaaacagctatactggtggcaattgacggagttctttgcggcatgatagccatcgccgacgctgtcaaacaggaagcggctctggccgtgcacacattacagtcaatgggggtggacgtcgtgttgatcaccggcgataatagaaaaactgcacgcgccatcgccacccaggtgggcatcaacaaggtattcgccgaagtgctgccctcacataaagtcgctaaggttcaagagcttcagaataagggtaagaaggtggctatggtgggcgacggggtgaacgatagcccggcattggcgcaggctgacatgggagtcgccattggaacagggactgacgtcgccatcgaagcagcggatgttgttttaatccggaacgatcttcttgacgttgtggccagcattcacctctcaaagcgcaccgtgaggcgtatccggattaatttagtgttggcactgatctataatttggtgggcatacccatagcagcaggcgtttttatgcccattggcatagttctgcagccgtggatgggatccgctgccatggccgcctcctcagtttcggtcgtcttatcatccctgcagctaaagtgttataaaaagcctgacctggaaagatatgaggcccaggcgcatggacacatgaaacccctgactgcctcgcaggtgtccgttcatatcgggatggatgaccggtggcgtgatagcccccgtgccactccatgggatcaggtgtcatatgtctcacaggtgagcttgagctcactcacctcagacaaaccaagcagacactccgctgccgccgacgatgacggagataagtggtctttattgctgaacggaagggatgaagagcaatatatctag

SEQ ID NO: 2383 - DNA, 4065 bp, Artificial Sequence
  Description of Artificial Sequence: Synthetic coding sequence
atgcctgagcaggagcgtcagatcactgctagggagggcgcctcccgcaagatattgagcaaattatcactgcccacccgcgcttgggagcccgctatgaagaagtcctttgccttcgacaatgtaggctatgaggggggactggacggcctgggtcccagtagtcaggtagccacaagcactgtgagaattctcggcatgacctgccagtcctgtgtgaagtccatagaagatcgaatctccaatcttaaaggtatcatcagcatgaaggtgagcttggaacaaggtagcgctaccgtgaagtacgtgccctctgtcgtgtgcttacagcaggtctgtcaccaaatcggcgacatggggttcgaggcctcaatcgctgaggggaaagcagccagttggccatcaaggagcctgcccgctcaagaagcggtggtaaagcttagggtggaaggtatgacctgccagagttgtgtttcgtcaattgagggaaaagtgcggaagttgcaaggtgtggttcgcgtgaaagtatcactttctaaccaggaagccgtgatcacctaccagccgtaccttattcagccggaggacttaagagaccacgttaatgacatgggattcgaagccgctatcaagtctaaggtagctcccctgtcactgggccccattgacatcgagcgcctgcagtctacgaatccaaaacgccccctcagctcagcgaatcagaatttcaacaatagcgaaactctgggtcaccaaggaagccacgtagtcacactgcagttgaggatagacggaatgcattgcatgatcagccagttggagggcgtgcagcagattagcgtcagcctggccgaaggcacggcaacagtgctgtataatccctcggtgatctcacccgaagagctgcgagccgcaatcgaggacatgggatttgaagcatcagtcgtttctgagagctgctctacaaaccctctcggaaaccactcggccgggaattctatggtgcagactacagatgggactcctacctccgtccaggaggtggcacctcacacaggtcggctcccggcaaatcacgccccggatatcctggctaaatccccccagtcaactcgggccgtggccccccagaaatgctttctgcaaatcaagggcatgacgtgcgcatcttgtgtgagcaacatagagcggaacctccaaaaagaagccggagtcctgtcagtgctggtggcccttatggccggtaaagcagaaataaagtatgaccccgaagtaattcagcctctggaaatcgctcaatttatacaggacctcggattcgaggccgcagttatggaggactacgctgggtccgatggaaacatcgagctcaccatcaccggcatgacctgcgcgtcttgcgtacacaatattgagtctaaacttacacggaccaatgggatcacgtacgcatccgtagcgctggctacttctaaggccctcgttaagttcgatccagagattataggccctcgagacatcattaaaatcatcgaagagatcggctttcatgcatcactggctcagaggaaccccaacgcccatcaccttgatcacaagatggaaatcaagcagtggaagaagagtttcctgtgctcgctagtgttcggcattcccgtaatggccctgatgatttacatgctgatcccgagtaacgaacctcatcaaagcatggttcttgatcataatatcatccctggtttgagtatactgaatctgattttttttattttatgtacctttgtccagctcctggggggctggtatttctatgtgcaggcctataagtctctcagacaccgttcagccaacatggatgtgttaattgtattggccacctctattgcgtacgtttacagtttggtcatattggtggtggcagtggcagagaaggcggagcgctcaccggtgaccttcttcgatacccctccaatgttatttgtgttcattgccctgggcagatggctcgaacatttggccaagtcaaaaacctctgaggcactcgcgaagcttatgtcgctgcaggccaccgaggctaccgtcgtgaccttgggggaagataaccttattattcgggaagagcaggttcccatggagctggtgcaaaggggagatatagtgaaggttgtgcccggaggaaagttcccagtcgacgggaaggttttggaaggcaatactatggctgacgagtccctcatcaccggggaggcaatgcccgtaaccaagaagccaggcagcaccgttatcgctggctctatcaatgcgcacggaagtgtgctgatcaaggctacccacgtcggaaacgatacaaccttagcccagatagtgaagcttgtcgaggaagcacagatgtccaaggcccccatccagcagcttgccgaccgattcagcggctatttcgtcccatttattattataatgtccactctgactctcgtagtgtggatcgtgattggctttatcgatttcggcgtagtgcagcggtattttcctaatccgaacaagcacatttctcagactgaggtgatcattagattcgcatttcaaacttcaattacggtgctgtgcattgcttgcccctgttccctaggactcgccactcctacggccgtcatggttggtaccggcgtagccgcgcaaaacggcatcttaatcaaaggcgggaaaccgcttgaaatggctcacaagatcaagacggtgatgtttgataagactgggaccatcacacatggagtgccccgggttatgcgggtacttcttctcggcgatgtcgctaccttacctctgcggaaagtgttggcagtggtggggaccgcagaggcatccagtgagcaccccttgggggttgccgtcactaaatattgtaaggaggaactcgggaccgagacccttggttactgtactgactttcaggctgtccctggatgcggcataggctgcaaagtgagtaatgtagaaggcatcctcgcccactcggaaagacccctctccgccccagcttctcacctgaatgaggcaggcagcctgccagcagaaaaggatgctgtgccccagactttcagcgtcctgattggaaaccgggagtggctcaggagaaacggtcttaccattagctctgacgttagtgatgccatgacagaccacgagatgaagggccagacggcaattctagtcgccatagacggcgttctttgcgggatgatagctattgccgacgcagttaaacaagaggccgccctggccgtccacaccctgcagtctatgggcgtggatgtggtcctgattactggtgacaaccggaaaactgcacgcgccattgccacacaggttggcataaataaagtctttgccgaggtgctgccaagtcataaagttgccaaggtccaggagctgcaaaataagggtaagaaagtggcaatggtcggagatggcgttaacgactcacccgcactggctcaagctgacatgggcgttgccattgggaccggcactgatgtcgctatagaggctgcagatgtggtgctgatccggaatgatctgctggacgttgtcgcatctatacatctgagcaaaagaacagtgcgtagaatacggattaatctagtcctggcgttaatttataatctcgtaggcataccgatcgctgccggtgtgtttatgcccattggaattgtcctgcagccgtggatgggctccgccgcgatggccgcatcatccgtaagcgtcgtcttatcttccctccagctgaagtgctataaaaaacccgacctcgaacgctatgaggcccaggctcacggtcatatgaagccactcaccgccagccaggtctccgtgcacataggcatggatgacaggtggagggactcaccaagggcaaccccatgggaccaggttagttacgtgagtcaggtctctttgtcaagcctgacaagtgataagccatcccggcactcggcggcggcggacgatgatggggataagtggagtctgctgctgaacggtcgagatgaagagcagtatatatag

SEQ ID NO: 2384 - DNA, 3108 bp, Artificial Sequence
  Description of Artificial Sequence: Synthetic coding sequence
atgcctgagcaggaacgccagatcactgcccgcgagggcgctagtcgaaagatactctcaaagttgtcactgcccacccgcgcctgggagcctgcaatgaaaaaatccttcgctttcgacaatgttggctatgagggggggctggacggactcgggccatcctctcaggtcgccaccagtaccgttaggatcctgggaatgacatgccaaagctgtgtgaaatctattgaggataggatctcgaatctgaaaggcatcatcagcatgaaggtgtctttagagcagggcagtgcaactgtgaaatatgtccccagtgtggtatgtctgcagcaagtctgccaccagatcggggatatgggtttcgaagcatccatagcagagggcaaggccgcctcatggccttcaaggtcactacctgcccaggaagctgtggttaaactacgagtcgaaggcatgacctgtcagtcgtgtgtgagcagtattgaaggtaaagtgcgaaaactgcagggggtggtgcgggtgaaagtgtctttatccaatcaggaggccgtgattacataccagccctaccttattcaacctgaagatttacgagatcatgttaacgacatgggcttcgaagccgcgattaagagcaaagtggcaccgttatccctaggcccgattgacatcgaaagacttcaatcaacgaatcctaagagaccgctctcttccgccaaccagaactttaataacagcgaaacacttggccaccagggatcacatgtggtcacactccaacttcggatcgacgggatgcactgcaagtcctgcgtgcttaatatcgaagagaacattggtcagttactcggagtccagagtatacaagtgtccctggagaacaagacagcacaggtgaaatacgacccatcttgtacctcacccgtcgcccttcagcgggccatcgaggctttgcctcctggcaacttcaaggtcagcctgcccgacggcgctgaaggctctggcactgatcatagatcgagcagcagccatagccccggcagcccgccacggaaccaggtgcagggaacatgttccaccacccttatcgctattgcaggtatgacctgtgcgagctgcgttcacagcatagagggcatgattagccagcttgagggcgtacagcagattagcgtatcactggcagagggtaccgctaccgtgttatacaaccccagtgtcatctctcccgaagagctgagagccgccatcgaggatatgggttttgaagccagtgtcgtgtctggagaagcaatgcctgtcacaaaaaaacctgggagcactgtgatagctgggtcaataaatgctcatgggtccgtgttgatcaaagcaacccacgtaggaaatgacactacactagcacagatagtcaagttggtggaagaggcccagatgtctaaggcacctatacagcagcttgccgatcgcttctcaggatatttcgtgccatttattattatcatgtctactttgacattggtggtctggatagttatcggtttcatcgatttcggtgtagtgcaacgctacttcccaaatccgaataaacacattagccagacagaagtgatcattagattcgcctttcagacttcaatcacagtgctctgtattgcttgtccatgcagcctcgggcttgcgactcccaccgccgttatggtcggtaccggagtggctgctcaaaatgggattctgatcaaggggggcaagcccctcgagatggcccacaaaataaaaacagttatgttcgataaaactgggacgataactcacggagtgcctcgagtaatgcgggtgctcctacttggggatgtggctaccttgccgctcagaaaggtgttagcagtggtgggcactgcagaggctagctccgagcatccactgggcgtggcagttacaaaatattgtaaggaagaactcggtaccgagacacttggttactgcaccgattttcaggctgtccctggttgtgggattggatgtaaggtgtctaacgtggagggtatcctggcccacagcgagcgccccctgtccgctccagcttcccatcttaacgaggcgggctctcttcctgcagagaaagacgcagttccgcagactttctctgtcctcatcggcaatagagaatggctgcgcaggaacgggcttacgatttcctctgacgtctctgatgctatgactgaccatgaaatgaaggggcagacagcaatcctagtcgctatagacggggttctgtgtggtatgatcgccattgctgacgcggtgaagcaagaggcagccctggctgttcacactcttcagtcaatgggagttgacgttgtgttaattactggggataacaggaaaacagcccgagccatcgccactcaggtggggattaacaaggtgtttgcagaagtcttaccatcccacaaagtcgctaaggtgcaagagctgcagaataaggggaagaaggtagcaatggtgggtgatggcgtgaatgatagtcccgccctggcccaggctgatatgggggtggcaatcggaaccggaacagacgtggcgatcgaagcagcagatgtggtgctcatccgcaatgatctgctggacgtggttgcgtcaatccatctgtctaaaagaaccgtacgtagaatcagaattaatctggttctggctttgatctataacttagttggcataccaatcgcagccggagtctttatgcccattggaattgtgctccagccctggatgggctctgcagctatggccgcttcaagtgtctctgtggtgctgtcctcgttgcaattgaagtgctataagaagcctgacctcgaaagatatgaggctcaggcgcacgggcacatgaaaccactgacggcatcccaggtgtctgtgcatatcggaatggacgatcgttggcgtgattccccacgagcaaccccatgggatcaggtgtcttatgtctcacaggtgagtctttctagcctgacttccgataaaccctcccggcacagcgcagccgcagatgacgacggagacaagtggtctctcctactcaatggcagagatgaagagcagtatatttag

SEQ ID NO: 2385 - DNA, 2031 bp, Artificial Sequence
  Description of Artificial Sequence: Synthetic coding sequence
atggatgtcctgattgttctggcgacttctattgcctatgtgtactccctggtcatacttgtggtcgccgttgccgagaaggctgaacgctctcccgtcaccttcttcgacactccaccgatgctgttcgtcttcattgccctcggccgatggttggagcaccttgccaaatccaaaaccagtgaggctctggcgaagctcatgtctttacaggctaccgaggcaacagtcgtgaccctcggggaagacaacctaatcattagggaagaacaggtgcccatggagctggtacagcggggtgacattgtcaaggtggtgcccggaggcaagtttcccgtggatggcaaggtacttgagggaaatacaatggccgatgaatccttgatcacaggggaggccatgcccgtgacaaagaagccgggttccactgtgatcgcaggcagtattaatgcccacggctccgtgctgattaaagccacccatgtgggtaacgacacaacactcgcccagattgtgaagctggtggaggaagcccagatgtctaaagcaccgatccaacaactggccgacagattctcaggatatttcgttcctttcatcatcataatgtcaactctgacactggttgtctggattgtgatcggatttattgatttcggcgtcgttcagcgttatttcccaaatccaaataagcatataagccagactgaggtaattatacgcttcgccttccagacatccattaccgtattgtgcatcgcctgcccctgctctctgggtctcgcgacgcccacagctgtcatggtgggcaccggcgtcgccgcacaaaacggaatactcatcaaaggtgggaaaccgctcgagatggctcacaaggaactgggtactgagactctgggatactgtaccgattttcaggccgtgcccggttgtggcatcggatgcaaagtctccaacgttgagggcatccttgctcactccgagcggccactgagcgcccccgcctcgcatctgaatgaagcaggttccttgcccgccgagaaagatgcggtccctcagactttcagtgtgcttattggcaaccgggagtggctgagacgaaacggcctaactatttcgtccgacgtgagtgacgctatgaccgaccacgagatgaaggggcagacagccattctggtcgctatcgatggcgtgctatgcgggatgatcgccatagcggatgctgtgaagcaggaggcagctctggccgtgcatacacttcagtcaatgggcgtcgacgtggttcttataaccggcgacaacaggaagacagcaagggccatcgcaacccaggttggcatcaataaagtatttgccgaggttcttcctagccacaaggttgccaaagttcaggagctgcagaataagggcaagaaggtagccatggtgggagacggcgtgaatgatagcccagctcttgcacaggctgatatgggcgttgctatcggaactggaactgacgtggctatagaagctgcggacgtggttttgatccggaacgatctgttagacgtggtcgccagcatacacctgagtaagcgtaccgtcaggcggatcagaattaacctggtgctggccctgatatacaatttggtgggaattcccatagcggctggcgtgtttatgcctataggaatcgtcctccagccatggatgggatctgctgctatggcggcttcttctgtaagcgtcgtgctcagcagtctgcaactcaagtgctataagaagccggacctggagcgatatgaggctcaggctcacggccatatgaagcccttgactgcatcacaggtatccgtccacatcggaatggacgaccggtggagagactctcctcgcgccactccctgggaccaggtaagttatgtctctcaggtatcactatcttctctgacatccgacaaaccctccagacattctgcggcagcagacgacgacggtgataaatggagcctgctcctcaacggcagggacgaggagcagtacatatag

SEQ ID NO: 2386 - DNA, 4203 bp, Artificial Sequence
  Description of Artificial Sequence: Synthetic coding sequence
atgcccgagcaggagcggcagatcaccgcgcgcgagggcgccagtcgaaagatcctttcaaaactaagtctccctaccagagcttgggagccagcgatgaagaaatctttcgcctttgacaatgtgggctacgagggcggactggacggactgggccctagtagccaggtggctacctccaccgttcgtatcctgggcatgacctgccagagctgtgttaagtccatcgaagacagaatctcaaacctgaaaggcattatcagtatgaaagtgtcgttggagcaggggagcgcgaccgtgaagtacgtgcccagcgtcgtatgtctccagcaggtgtgccatcaaatcggagatatggggtttgaggctagcatcgccgaaggaaaagcggcctcttggcccagccgaagcctgccagcacaggaggcggtcgtcaagctgcgcgtagagggcatgacctgccagtcctgcgttagctctatagagggtaaagtccggaagcttcagggagttgtacgtgtcaaggtgtcgctttctaaccaagaagcggttatcacttatcagccttatctcatccagccggaagacctgagagatcatgtaaatgatatgggttttgaagccgctattaaatcaaaagtcgcccctctcagtttaggcccaattgatatcgaacgtctccaatccaccaatccaaagaggccactgagctctgctaatcagaacttcaacaattcagagactttaggacaccagggctctcatgttgtgactctgcaactgcggattgacggcatgcactgcaagtcatgtgtactgaatattgaggagaacatcgggcagcttttgggggttcagtctattcaggtctccctggaaaataaaaccgctcaagtgaaatacgacccttcgtgtaccagtccggttgcgttacaacgcgccatagaggctctacctcctggtaactttaaagtttctctgccagacggggcagaggggtctggcacagaccacaggtccagctcctctcactcccctggctccccaccgaggaatcaggtccaaggcacttgctcaactacactgatagccatcgcaggcatgacatgtgctagttgtgtacatagcattgagggcatgatatcccaactggagggcgtgcagcagatctccgtatctctagcagagggcaccgccacagtcttatataatccatctgtgattagtcctgaggagttgcgcgcagctattgaagacatggggttcgaggcctcagtggtttccgagagctgcagtacgaatccactgggcaaccactcagctggtaattctatggtgcagacaaccgatggcacgcctacgtctgtgcaagaagttgcgccacacactgggcgactgcctgccaaccacgcccccgacattctggcaaagtcaccccaaagcacaagggccgtggcaccacagaaatgctttctccagattaaaggaatgacttgtgcctcttgtgtgagtaacattgagcgaaatttgcagaaggaagctggggtgttgtcagtgctggtagccttgatggccggcaaagccgagatcaaatacgatcccgaggtgatccagcctctggagatagctcaatttattcaagacctgggtttcgaagccgctgtgatggaggattacgccggctccgacgggaacatcgagcttaccattaccggcatgacctgtgccagttgtgtgcataacattgagtctaagctgacccggactaatggtattacgtatgcctctgtggccttggccaccagtaaggcgctggtgaaattcgacccagagatcatcggtcctagggacattatcaaaataatcgaagagatagggttccacgcttcactggcccagaggaacccaaacgcacaccatcttgaccacaagatggagattaaacagtggaaaaaatcttttctgtgtagcctggtattcgggatacccgtcatggctctcatgatttacatgttaatcccaagtaacgaacctcaccaatccatggtcttggaccataatatcatacccggtcttagcatccttaacctgattttctttattttgtgcacattcgtccaactgctcgggggttggtatttttacgtccaggcctacaagtcgctccgccaccgatctgctaacatggatgtgcttattgtgctggctacctccattgcgtacgtgtactccctggtcattctcgtagtggcggtggctgagaaagctgaacggagccctgtcacctttttcgacacaccacccatgctcttcgtttttatcgctctagggcgttggttggaacatctggctaaatccaagaccagcgaggccctggccaagttaatgtctttgcaagccaccgaagctaccgtggtcactctgggcgaagataacttgataatcagggaggagcaggtcccgatggaactggtacagcgcggggatatcgtaaaggtggttcccggggggaaatttcccgtcgacggcaaagttttagaggggaacacaatggccgatgagtcccttatcaccggggaagccatgcccgttacaaagaagcctggttccactgttatagcaggaagtattaacgcccatggctcagtcctgattaaggcaactcatgtaggcaatgacacaaccctggctcagatcgtgaaactagtggaagaagcccagatgtcaaaggcccctattcagcagctggccgacaggttctcaggatacttcgtgcctttcattatcattatgagcactttgaccctggtggtttggatagtaatcggcttcattgatttcggagtggtgcagcgatatttccctatcaaaactgtgatgttcgataaaactgggacaatcacacacggagtgcccagagttatgcgcgtgctgctgcttggcgatgtggccacgctgccattaaggaaagttctggccgtggttggcaccgcagaggcctctagtgagcatcccctgggggtggccgtgactaaatactgcaaggaggagctgggcacagaaacacttggctattgcacggactttcaggctgtcccaggttgcggtattggttgcaaagtgtcaaatgtggaaggaattctggcacactccgagagacccctctccgccccggccagccatctgaacgaagctggatcgcttcctgcggaaaaggatgccgtgccacagacattctcggtactgatcggaaacagagagtggctccgccgaaacgggttgacaatatccagtgatgtgtcagacgcaatgacggaccatgagatgaaaggccagacagcgatcctcgtggctattgatggggtgctgtgtggtatgatcgcaatcgcagacgccgtcaaacaggaagccgccctggctgtgcatactctgcaatccatgggagtggacgttgtcctgattacaggagataaccgtaagaccgccagggctatcgcaacccaggtgggcataaataaagtgttcgctgaggtgctgccaagccataaggtggctaaggtgcaggaactacagaataaaggtaagaaggtggccatggtaggagacggagtgaacgactcccctgctttggcacaggcagatatgggagtcgctatcgggaccgggaccgacgtggccattgaagctgcagatgttgttctgataaggaacgacctgcttgacgttgtcgctagtatccacttaagcaagcggaccgtgagacgtatacgcataaacttagttttggccctgatttacaacctggtggggatacctatcgccgcaggagtctttatgcccattggcattgttctacagccatggatgggttcagcagctatggccgcctcatccgtatctgtcgtcctgagctcactccagctgaaatgttataagaagcctgatctggaaaggtacgaggcccaggctcacggccatatgaaaccacttacagcaagccaagtctccgtacacattgggatggacgacagatggcgggactcaccccgtgccaccccctgggatcaggtgagttacgtctcacaggtaagcttgtcctccttaacttcagacaaaccgtccaggcactccgcagcagccgacgacgacggcgacaaatggtcccttctgctcaacggtcgcgatgaagagcaatatatatag

SEQ ID NO: 2387 - DNA, 4164 bp, Artificial Sequence
  Description of Artificial Sequence: Synthetic coding sequence
atgcccgaacaggagagacagataacggctcgagaaggggcttccagaaaaatcctgtctaagctcagtcttcctacgagggcctgggagccagctatgaaaaagtcttttgccttcgacaatgtgggctatgagggtgggctggacgggcttgggcccagcagccaggtggcaacgtccaccgtaaggatcttgggaatgacctgccagtcatgcgtgaagtccatcgaggatcgaatctctaacctcaaaggcattatctctatgaaggtgtccctggagcagggatccgctacagtgaagtatgttccttccgtggtctgtctccagcaggtgtgccaccaaatcggagacatgggattcgaggcttctatcgccgagggaaaggccgcttcctggcccagtcgctcactccccgcccaagaagccgtcgtcaaattgagagtcgagggaatgacttgccagtcctgcgtgtcctccatcgagggaaaagtgcgaaagctccagggtgttgttcgggtgaaagtgagtttgtcgaatcaggaagcagttatcacctaccaaccgtatttgattcagcctgaagacttacgcgaccatgttaacgatatgggttttgaggcagctatcaagagcaaagtggcacctctgtccttgggaccaattgatatcgaacgcctgcaatccacgaaccccaaacgacccctgtcctccgcaaatcagaatttcaataattccgaaacgctgggccatcaaggtagtcatgttgtgaccctccagctcaggattgatggcatgcattgtaagagctgtgtcctcaacattgaggagaatatcggacagttgctgggggttcagtcgattcaagtgagtctggaaaacaagacagcacaagttaagtacgatccatcatgcacaagcccggtggccctgcagagagcaattgaggcactgcccccagggaacttcaaggtgagcttgccggacggcgctgagggatcagggaccgatcacaggagctcaagtagccatagcccaggtagcccgccgaggaaccaggtgcaagggacctgctcgactacgctgatcgccatcgctggaatgacatgtgccagctgcgtccattctatcgaagggatgatttcccagctagaaggggtgcagcaaatttccgtgagcctggctgagggtactgcgactgtgttgtacaatccctccgtcatcagtccagaggaactgagggcagctattgaagacatgggttttgaggcgtctgtagtttctgagagctgctctactaaccccctgggtaatcattctgccggcaatagcatggtacagaccacagacggaactcctacctctgtccaggaagttgctccacatacagggcgcctgccagcaaatcatgcccccgatatcctggccaaatcaccccagtcaactagggcggttgcaccgcagaaatgcttcttgcagatcaaggggatgacatgcgcctcctgcgtgtcgaacatagaacgtaatctgcaaaaggaagctggagtcctgtccgtgttggtagcgttgatggccggtaaggctgaaataaaatacgatcccgaggtgatccagccccttgagatcgcccagttcatccaggatctaggtttcgaagcagcagtgatggaagattatgcaggcagcgacgggaacatagaactcactatcaccggtatgacatgcgcaagctgtgtgcacaatatagagagcaagctgaccaggaccaacggcattacatacgcttcagtcgctctggctacaagcaaggccctagtcaaattcgatccagaaataattggccctcgagacattatcaaaatcattgaggagattggattccatgctagcctggcccagcggaaccctaatgcccaccacctggaccacaagatggagattaagcagtggaagaagtccttcctgtgttctctggtcttcggcatacctgtgatggcgctgatgatatatatgctgattccatccaacgaaccacaccaatccatggtgctcgatcataacatcatccctggcctatccatcctgaacctaatattcttcatcctctgcacatttgttcagtccaaaacgagcgaggcactagctaagctgatgagcttacaggccacagaggcaactgtggtcactctcggcgaggacaaccttatcattagagaggagcaagtgcccatggaactcgtccaacggggtgatattgtgaaggttgtgcctggcggaaagttccctgtcgatggaaaggtactggaagggaataccatggctgacgagagcttgatcacgggagaagcgatgcctgtgactaagaagcccggctccacagtgatcgcaggatccatcaatgcacatggaagtgtgctgattaaggccacacacgtgggcaatgatactaccctagctcagattgtgaagctggtggaggaagcacaaatgtctaaggctccaatccaacagctggccgatagattttcggggtactttgtacctttcatcattatcatgtctaccctgacactggttgtttggatcgtgataggattcatcgacttcggagtagtccagcggtacttcccaaacccaaacaaacacattagccaaaccgaggtgataatccgcttcgcttttcaaacgtcaatcaccgtactgtgcatcgcatgtccatgctcactgggtctcgcaactcctacagccgtgatggtgggtaccggggtcgctgctcagaacgggattctgattaagggcggaaagccgctggagatggcacacaagatcaagaccgtgatgtttgataaaacgggcactattacacatggagtgcctagagtcatgagggttctgttactgggtgatgtggccactctcccactgcgaaaggtgctggcggtggtcggtactgcggaagcatcctcggagcacccgctgggcgtggcagtgaccaaatattgcaaggaggagctcggaaccgagactcttggatactgcacagacttccaagccgtacctggctgtgggatcggatgcaaagtatctaatgtcgaggggatcttggctcactccgagcgccccctgtcagcacccgcctcccacctcaacgaagcaggctctcttcctgccgaaaaggatgctgtgcctcagaccttttcagttcttattggcaatcgcgaatggctgcgccgcaacgggctgactatatccagcgatgtgtctgacgctatgaccgatcacgaaatgaagggacagacagcgattctggtggcgatcgatggtgtcctgtgcggcatgatagccattgcggatgccgtgaaacaagaagcagctctcgccgttcacactttacagagtatgggtgtcgacgtcgtgctgatcacaggggataacagaaagactgctagagcaatagctactcaagtagggattaataaagttttcgcagaggtgctcccgagtcataaggtggccaaagttcaggagttacagaataagggcaagaaggtcgcaatggtgggcgacggcgtgaacgactcacctgcccttgctcaagccgacatgggagtggccatcggcaccggcaccgacgttgcaatagaggccgctgatgtggtgctgataagaaatgacctgttggacgtggtcgcaagcatccacctctctaaaagaaccgttcggcggatccgcattaacctggtgttggccctcatatacaatctggtgggaatccctatcgccgcaggcgtctttatgcccattggaatcgtgctgcagccttggatggggtcagctgccatggcggctagctctgtctccgtggtactgagtagcctgcaacttaaatgttacaaaaagccggatcttgagcgttacgaggcccaggcacatgggcacatgaagccactgacggcatcccaggtgtccgttcatatcggaatggacgatagatggcgtgatagccctagggccacgccttgggaccaggtcagttatgtgagccaagtgtcactctcgagcctgaccagtgataaaccttcccgtcattctgccgccgccgacgatgatggcgacaaatggagcctccttctgaatggcagagatgaggaacaatatatctag

SEQ ID NO: 2388 - DNA, 1587 bp, Artificial Sequence
  Description of Artificial Sequence: Synthetic coding sequence
atgaagaagagtttcgcttttgataatgtaggatacgaagggggcctggacggcctgggcccgtcaagccaggtagctacctcaaccgtgcggatactgggcatgacttgtcagagttgcgtcaagagcatcgaggacagaatttcaaacctgaaggggattatctcaatgaaggtctcgctcgaacagggcagcgccaccgtaaagtacgttccaagtgttgtttgcctgcagcaagtttgtcaccagattggtgacatgggatttgaagcaagtatcgccgaggggaaggcagcaagttggccaagccgatccctgccggctcaggaagccgtcgtgaagctgcgcgtcgagggcatgacatgtcaaagctgcgtgtcttccatcgagggtaaggttcggaaactgcagggagtggtgcgagtcaaggtctccctgtccaaccaggaggcagtgatcacctatcaaccttacctgattcaacctgaagatctcagggatcatgttaatgatatgggtttcgaggccgccatcaagtcaaaggtagcccctctctccctcggcccaatcgatattgagagactgcagtcgacaaatccaaagcgaccgctttcatcagcgaatcagaactttaacaactctgagacattaggtcaccaagggtcccacgtcgtaacgctacagctgcgaattgatggcatgcactgcaagtcctgcgtacttaacatcgaggagaacattggccagctgttaggcgtgcagtccatccaggtcagcctggaaaataaaaccgcccaggtgaagtacgaccccagctgtacatccccggtagcgttacaacgggccattgaagctctacctcctggcaactttaaggtgtcccttcctgacggggcagagggaagcggaacagaccaccgctcgagtagttcacatagccccggatccccgcctaggaatcaggtgcagggaacctgctcaacaaccttgatagctatcgctggtatgacctgtgcttcctgcgtacattcaattgaaggtatgatttctcagctggagggtgttcagcagatcagcgtaagcttggccgaaggcaccgcgaccgtcctgtacaatccatccgtgattagtcctgaggagctacgtgcagcaatagaagatatggggttcgaggccagcgtggtgagcgagagctgtagtactaatcctctggggaaccattccgctgggaactctatggtacagactaccgatggtacaccaacttccgtgcaggaagtcgccccccacaccggtagattgcccgctaaccacgcacctgacatcctcgcaaaatccccacagtcaaccagggccgttgccccacagaagtgtttcctccagattaaagggatgacctgcgccagttgtgtaagcaacattgagaggaacttacaaaaggaagctgcccctaggtgggtcgtgcttttgaggtcaggactgcagatatcagagacacaggtctcccagcacggccgggcacaccggccaggccacaagcattgcctttgcctgttcagcggccaccccggagggtgctgcgggtag

SEQ ID NO: 2389 - DNA, 3966 bp, Artificial Sequence
  Description of Artificial Sequence: Synthetic coding sequence
atgtcagattctgtcattctgcgatctattaagaagttcggcgaggaaaacgacggctttgagtcggataagagctataacaacgataagaagtcccgattgcaggacgagaagaaaggcgatggcgtccgcgtgggtttcttccagctcttcaggttttccagttccaccgacatctggttgatgttcgtaggctctttgtgcgcatttctgcacggcatcgcccagcccggagtacttctgatcttcggaacgatgaccgatgtgttcatcgattatgatgtcgaactgcaggaactgcagattcctggaaaggcctgtgtcaataatacaatcgtctggacgaattcctctctcaatcagaacatgacaaacgggacacgttgtggactgctgaacatcgagagtgaaatgatcaagttcgctagctactatgccgggattgcggtcgcagtgcttatcaccggctacattcagatctgcttctgggtcatcgctgcagctaggcagattcagaagatgaggaagttttacttcaggaggatcatgcgcatggaaattgggtggtttgattgcaacagtgtcggagagctcaatacaagattttccgatgacatcaacaaaattaatgatgctatcgctgatcagatggccctgttcatccaaaggatgacgtcaaccatctgcggcttcctgctgggcttctttcgaggctggaagcttacgctggtcatcatatctgtcagccctctcatcggcattggagccgccacgatcgggttgagcgtctccaaatttacggattatgaactcaaggcatatgccaaagctggcgttgttgcggacgaagtaatctcaagcatgcgaacagtcgccgcatttggaggcgagaagcgggaggtagagcgatacgagaaaaacctggtgtttgcccagcgttggggcatccggaagggcatcgtcatgggcttcttcactggcttcgtatggtgtctgatcttcctgtgctatgccctcgccttctggtacggaagtactctcgttctggacgagggtgagtacaccccaggaaccctagtgcagatctttctgagcgttattgtaggtgcattgaacctgggcaacgctagcccatgcctggaagcattcgccaccgggcgagccgcagcaacgagcatttttgagactatagataggaaacctatcatcgattgcatgtctgaggatgggtacaaactggatagaattaagggtgagatcgagttccataatgtgacctttcactatcctagtcgaccagaggttaaaatcctgaatgatttgaatatggtcatcaaacccggggaaatgaccgctctggtgggcccgagcggcgccggcaagagcactgcccttcaattgatccagcggttttacgatccatgtgaaggaatggtcacggtagatggacatgatatccgcagcttgaatattcaatggctcagggaccagataggcattgtggagcaggagcctgtcctcttctctacaaccatcgccgagaatataagatacggccgggaggatgcaacgatggaagacatcgtacaggccgctaaagaggccaatgcctataacttcatcatggacctgccacaacagttcgatacgctggtcggcgagggaggggggcaaatgtcaggcgggcagaagcagagggtagcgatcgctcgcgccctcattcgtaacccaaaaatattgctcttggacatggccactagtgcgctggataatgaatcggaggccatggtgcaggaggtactgtctaagatacagcacggccacacaataatctctgtggcccacagattgtctaccgtaagagcagccgatactattatcggcttcgaacacggaactgcggtagagagaggcactcacgaggagctgcttgaacggaagggagtctatttcaccctggtgactctccagtctcagggaaaccaggctttaaacgaagaagatattaaggacgccacggaagacgatatgctggcgcgcaccttcagtagaggttcctaccaagattccctgcgtgcaagcattcggcagcggagcaaaagccagttatcttatttggtccacgaaccacctctcgctgttgttgaccataagagtacatacgaggaagatcggaaggacaaggatattcccgtccaagaggaggttgaacctgcaccagtccgccgtattttgaagtttagtgctcctgaatggccctacatgttggtgggatccgtgggcgccgcagtcaacggcacagtaactcccctgtacgcctttcttttctctcagattctgggaacattctctattcccgataaggaggagcagcgaagccagattaacggcgtttgccttcttttcgtggccatggggtgtgtcagtctgttcacccaattcctacagggctacgcctttgcaaagagcggcgagctcctaacaaagagacttcgcaagttcggatttagggccatgttggggcaggacatcgcctggttcgacgatctcaggaatagtccaggagctctgacaacgcgcttagccactgacgcatcccaggttcagggtgccgccggatcacagattgggatgattgtcaactcctttacaaacgtgactgttgcgatgattatcgccttctccttttcctggaaattaagcctggtcatcctgtgtttcttcccattcctggccctgtccggagccacccagacacgaatgttaaccggattcgcgtcacgagacaagcaggccctcgagatggtggggcagattaccaacgaggctctttccaatatcaggacagtcgccggcattggcaaagagcgcagatttattgaagcgctcgaaaccgaattggaaaaaccgtttaaaactgccatacaaaaggctaacatctatggcttttgctttgcgttcgcacagtgcatcatgttcatcgccaactctgcatcctacaggtatggtggttacctgatatccaatgaagggctccatttctcttatgtgttcagagtcatctcagctgtcgtactgagtgccactgccttaggccgggcttttagctacacaccaagctacgcaaaagccaagatctccgctgcccggttttttcaactgctggataggcagccaccaatctcagtgtataacaccgccggggagaaatgggacaattttcagggtaagatcgattttgttgactgtaaattcacatacccaagtcgacccgactctcaggtgctaaacggactgagcgtcagcatatcgcctggccaaacactggcctttgtgggtagtagtggttgcgggaagagtacctccattcagttgctggaacgattttatgacccagaccaggggaaggtgatgattgatggccacgatagtaagaaagtaaatgtacagttcctccggagcaacatcgggattgtgtcacaggagccggtgctatttgcctgcagtattatggataatattaaatatggtgataacaccaaagagatcccaatggagcgtgttatagccgcggccaagcaggcacagttgcacgatttcgtcatgagtctgccagagaagtacgagacgaacgtcgggtcacagggatcacagttgagcaggggagagaaacagaggattgccattgcacgggctatcgtacgggaccctaagattctcctgctggacgaagctacaagcgcactggataccgagagcgaaaagaccgtccaggtggcattggataaagcacgcgaaggccggacatgcatcgtgattgcacaccgtttatccaccatccaaaatgcagatatcattgcggttatggctcagggggtggtgatcgagaaagggactcacgaagaattgatggctcaaaaaggggcctactacaagctggttacaacaggatctccaattagttag

SEQ ID NO: 2390 - DNA, 3861 bp, Artificial Sequence
  Description of Artificial Sequence: Synthetic coding sequence
atggacttggaagcggccaagaatggcaccgcttggcgacccaccagtgccgaaggtgatttcgagttgggaatctcatccaaacagaagaggaaaaaaaccaaaactgtcaagatgataggagtactgactctgtttcggtatagcgactggcaggacaagttattcatgtctctcgggaccatcatggccatagcccacggaagtggccttccactgatgatgatagtgttcggagagatgacagataagtttgtggatactgcagggaacttctcctttcctgtgaatttttcgctcagtctcttgaaccctggaaaaatcctggaggaggaaatgaccaggtacgcatattactacagcggactgggcgccggcgtgctcgtggcggcctatatccaagtctcattctggactttagcggcaggccggcagattcggaagatacgccagaagttcttccacgccattctcagacaggagatcgggtggtttgacattaacgataccactgagcttaataccaggcttactgacgacatcagcaagatttctgagggcatcggggacaaggtggggatgttcttccaggccgtggcgactttcttcgctggctttatcgtggggtttattaggggctggaaactcaccttagtgattatggccatctctccaatcctgggtctttcggccgctgtgtgggcgaagatcttgtcagctttttctgataaggagctggccgcttatgccaaggccggtgctgtggccgaagaggcccttggtgcgatccgtaccgtgattgcgtttggcggacagaacaaggagcttgagagataccaaaaacacctggagaatgcaaaagagattggtatcaaaaaggcaatctcggcaaatattagcatgggaatcgcattcttactgatctacgcgtcctacgcactcgccttctggtatgggagtacactggtcatttccaaggagtacacaattggtaatgctatgaccgtctttttctctatactcattggggccttctccgtcggccaggccgcaccatgcattgacgctttcgccaacgccaggggtgcggcttacgtaatttttgatatcatcgacaataaccctaaaattgattcattttccgagcgcggacataaaccggatagcattaaaggaaatctcgagtttaatgatgttcatttctcgtatccctcacgtgcaaatgtgaagattctcaaggggctgaatctcaaagtgcagtctgggcaaaccgtagctcttgtgggttccagtggctgcggaaaatcaaccaccgtccaactcatccagcgcctgtatgatcctgatgagggaacaattaacattgatggccaggacataaggaacttcaacgtgaactatctaagggagattatcggggtcgtttcccaggagcccgtccttttttcaacaaccattgccgaaaatatctgttacggtagggggaacgtgaccatggatgagatcaagaaggccgtcaaggaagcgaacgcttacgagttcatcatgaaactgcctcagaagtttgataccctggtgggagaaaggggcgcccaattgtcaggaggacagaagcaacgcattgctattgcacgcgctctcgtacgaaaccccaagatcttgctcttggacgaagccacctcagccctggacaccgagagcgaggccgaggttcaggcagccctggacaaagccagggagggccggaccacaatcgtgattgcccaccggctgagcaccgtccggaacgcggacgtgatcgccggcttcgaggatggcgtgattgtggagcaagggtctcattcggagctaatgaagaaggagggagtgtatttcaagctggtgaatatgcagacctccgggagtcagatccaaagcgaagagttcgaactgaatgacgaaaaggccgccacacgaatggcccctaatggctggaaaagccggttatttaggcattctacacaaaaaaatttgaaaaactcccaaatgtgccagaagagtctggacgtagagactgacgggcttgaggccaacgtgccaccggtgtccttcctgaaagtcctcaagcttaataaaactgaatggccatactttgtggtcgggaccgtgtgcgcaattgctaatggcggtctgcagcccgctttttccgtcatcttttctgaaattatagccatctttggccctggcgacgacgcagttaagcaacagaagtgcaacatcttttcactgatttttctttttctgggaataatttccttctttaccttctttcttcaaggatttacatttggtaaggcaggcgagatcctgacaaggagattgcgctccatggcttttaaggctatgctgcggcaagacatgtcctggttcgacgaccacaaaaactctaccggagcccttagcacccgattggccactgacgccgctcaggttcagggtgctacggggactagattggccctgattgctcagaatatagccaatttagggactggaattatcatttcttttatctacggctggcagctgacgcttctgttactcgcggttgtgcccatcatcgccgttagcggaatcgttgaaatgaaactgctcgccggcaatgcaaaacgcgataagaaggagctggaggcagccggaaaaattgcaacagaggccatagaaaatatccggaccgtggtgtccttaacccaagagcggaagttcgagagcatgtatgtggagaagctgtacggaccatataggaattccgttcagaaggctcacatctatggtataactttttctatctcacaggcatttatgtatttcagctacgctgggtgttttcggttcggggcctaccttattgtgaatggtcatatgcgctttagagatgttatattagttttctcagctattgtttttggtgccgtggctcttggacatgcctcctcctttgctccggattacgctaaggccaagctctccgccgcacacctgttcatgttgttcgagagacagcccctgatagattcttacagtgaggagggtctgaaacccgacaagtttgaaggcaacattacatttaatgaagtggtcttcaattatcctacacgggccaatgttccagtcttgcaaggactttccctcgaagttaaaaagggccagactttagccctcgtaggcagctccggctgtggaaagtcaacagtggtgcagctgctcgaacgtttttatgacccactggctggcactgttttcgtcgattttggtttccagctcctggacggacaggaggccaaaaagctgaatgtccagtggcttagggctcagttgggaatcgtttcccaggagccaattctatttgattgcagcatcgcagagaacatagcctatggggataatagtagagtcgtctcacaggacgagatcgtgtctgctgcgaaggcggccaacatacaccctttcatcgaaactcttccccataaatatgagacacgagttggagacaaaggaacccagttgtcagggggccagaaacagcggatagctattgcccgtgctttgatcaggcagccgcaaattttgctgcttgacgaagcaacttcagcacttgacaccgaaagcgaaaaagttgtacaggaggctctcgacaaggcaagggagggccgtacctgcattgtgatcgcacaccgcctgagcacaattcagaatgcagatctgatcgtcgttttccaaaatggaagagtaaaggaacacggaacacaccagcagctgttggctcaaaaggggatttatttttctatggtatctgttcaggctggcacccagaatctatag

SEQ ID NO: 2391 - DNA, 3699 bp, Artificial Sequence
  Description of Artificial Sequence: Synthetic coding sequence
atggaccttgaggccgctaagaatggaactgcatggcggcctaccagtgctgagggcgactttgaattggggatttcaagcaagcaaaaaagaaaaaagacaaaaactgtaaagatgatcggtgtcctgaccctctttcgctattcagactggcaggacaagttgtttatgtccctgggcactattatggcaatagcacatggctctggccttcccttgatgatgattgtatttggcgaaatgaccgacaagtttgtagacacggcagggaatttctcttttcctgtcaatttctcactgtcgctgctcaaccctggcaaaattcttgaagaggaaatgactcggtacgcttattactatagcggactgggcgctggagtcctggtagccgcatatattcaagtgagcttctggaccctggcagctggcagacagatcaggaaaatccgtcagaaattttttcacgccatcttacgtcaagagatcggctggttcgatattaatgatactaccgagctcaacacgagacttacagacgatatttcgaagatcagtgagggaatcggagataaagtcggaatgtttttccaggctgtcgccacctttttcgcaggttttatcgtgggatttatccgggggtggaagctgaccctggtgattatggcaatcagtccgattctagggctgagcgccgctgtgtgggcgaaaatcctgagcgcatttagcgacaaagagttagcagcctatgccaaagccggagccgtggccgaggaggctctgggcgccatcagaaccgtgatcgctttcgggggacagaataaggagctggaacgctaccaaaagcacttggaaaatgcgaaggaaattggtattaagaaggccatttccgccaatatcagcatgggaatcgccttcctgctaatctacgcttcctatgcccttgcattttggtatggatcaacactggtgatatccaaggagtacactatcggtaacgccatgacagtcttcttcagcatactaattggggcttttagcgtagggcaggctgccccctgcatagatgcattcgccaatgctcgaggggccgcctacgttatcttcgacattattgacaacaatcctaagatcgatagtttctctgagcggggtcataagcctgattctattaaagggaatctcgagtttaacgacgtccattttagttaccccagccgcgccaatgttaagatattgaagggcctgaacctcaaagtgcagagtggtcagactgtcgcacttgtgggatcatcaggctgtggtaaatcaacgaccgtccaactgatccagcgcctgtatgaccccgacgagggcacgattaacattgacgggcaggatatacgcaattttaatgtgaactatctccgggaaattatcggcgtggtgtcccaggagcctgtgctcttctccacgacgatcgccgaaaatatatgctatggtcgcggcaacgtgacaatggacgagattaaaaaagcagtcaaggaagccaatgcctacgaatttatcatgaagttgccccaaaagttcgatacactggtaggagaaagaggggctcagcttagcggaggccagaaacaacggattgccatcgctagagccttggtgcggaatccgaagatcctgctgctggatgaggctacaagtgccctggatacagagagtgaagcagaggttcaggcagctctggacaaagccagggaagggcgcacaactatcgtgattgcccaccggctcagtaccgttcgcaatgccgacgtgattgctggcttcgaggacggagttatagtagagcagggcagtcactcggagctgatgaaaaaagaaggcgtgtactttaagctcgttaacatgcagacgtcgggttcgcaaatacagtcagaggagtttgagcttaatgacgaaaaggcagctactcggatggctcctaacggctggaaaagtcgcctgtttcggcacagtacacaaaagaacctgaagaattctcagatgtgtcaaaagtccctggacgtagaaaccgatgggctagaggcgaatgttccacctgtgtcctttctaaaggtgctaaaattgaacaaaaccgaatggccgtacttcgttgtgggcacagtctgcgctatcgctaacggtgggctgcagcccgcattctctgtcatcttttccgagatcatcgcaatctttgggcccggtgacgatgcagtcaaacagcagaagtgtaatattttttcccttatttttctatttctgggaatcatcagtttctttacattcttcctgcagggtttcactttcggaaaagccggggaaatcctaaccaggcgactcaggtctatggccttcaaggctatgttaagacaggatatgagctggtttgacgaccacaagaattctaccggggccctgagcactaggctggccacggacgccgctcaggtccagggcgcaacaggcacaagactggcccttattgcccagaacatcgccaaccttggaacaggcattatcatctctttcatctatggttggcaacttacccttttgctattagccgtcgtgccgattattgcagtttcaggtattgtggagatgaaactcctggcgggaaatgcaaaaagggataagaaggaactcgaggctgcaggcaagattgcaacagaagcgattgaaaacatcaggacagtggtgagcctgacgcaggagcggaagttcgagagcatgtatgtggaaaaactgtatgggccttacagggtgttcagcgctatcgtgtttggtgcggtggctctgggccacgcgagttcgttcgcaccggattatgctaaggcaaagctgagcgctgcccacctctttatgctttttgagcggcagcctctgatagactcctatagcgaagaaggcctgaaacccgataaattcgagggaaacataacgttcaacgaggtggtttttaattacccaactcgagccaatgtccccgtactacagggcctctcacttgaagtcaagaaaggacagacgctggcacttgtgggatcttcagggtgcggtaagagcacggtggtgcaactcctagaacggttttatgacccactggcagggacggtgctcctagacgggcaggaggccaaaaagcttaacgtgcaatggctgcgggctcagttagggatcgtctcccaggaacccatcctgtttgactgttccatagccgagaatattgcctacggcgacaattcccgcgtggtgtcacaggatgagattgtgtcagccgccaaggccgccaacattcatcctttcatcgagaccctgccgcacaagtacgagactagagtgggggacaagggcacccagctgagcggaggccagaaacagagaatcgccattgctagggcactgatccggcagcctcagattctactcctagacgaggcaacttctgccctggacacagaatcggagaaggttgtgcaagaagctctggacaaggcccgagaaggccgcacttgtatcgtgatagcacacagactctcaaccatccaaaatgccgatttgattgtcgttttccaaaatggtcgggtgaaggaacatggcacacatcagcagttgctcgctcagaaaggaatctactttagcatggtgtctgtgcaagcgggaacccagaatctctag

SEQ ID NO: 2392 - DNA, 3840 bp, Artificial Sequence
  Description of Artificial Sequence: Synthetic coding sequence
atggatttggaggctgccaaaaatggtacggcctggagaccaacgagcgccgagggcgacttcgagttgggaatctcttcaaagcagaaaagaaaaaagactaagacagtaaagatgattggtgtcctgactctattccgatactctgattggcaggacaagctgttcatgtcactggggactattatggctatcgcacacggcagcggtctgccacttatgatgattgttttcggagagatgactgataagttcgtggacaccgccggaaatttctctttcccagtgaacttcagtctgagtctgctgaaccctggcaagattctggaggaggaaatgacgagatatgcctactactacagcgggttgggtgctggagtgcttgtggctgcatacattcaggtatcattttggactctcgctgccggcagacagatcaggaagataagacagaaattttttcacgcaatactgcggcaggagatcggctggttcgacattaatgataccactgaattgaataccaggctaactgacgatataagtaagatttccgaaggtataggcgataaagtaggtatgttctttcaagccgttgccaccttcttcgcgggcttcatagtggggtttattcgtggctggaagcttacattggtgatcatggcgatcagccctatccttgggctgagtgccgctgtgtgggcaaaaattctgagcgcatttagtgacaaggaattggctgcttatgcaaaggccggcgcagttgccgaggaggctttgggagccattcgaaccgttattgcatttggcggccaaaataaggagctggaacgataccagaaacatctggaaaacgcaaaggaaattgggatcaagaaagccatctctgctaatatctcaatgggcattgccttcctcctcatttatgcgagctatgctctcgcattttggtatggatctactctggtaatctctaaagaatataccattggcaatgccatgactgtctttttctccatcctaattggcgcctttagtgtaggtcaggccgccccttgcatagatgctttcgctaatgctcgaggagccgcttacgtcatttttgacatcatcgacaataacccgaaaatagactcattctctgagaggggacataaacccgacagtattaaggggaatctggagtttaatgacgtgcacttctcctacccgtcaagagcaaacgttaaaatcctgaaaggcctgaacttaaaggtacagagcggacagaccgtagccctcgtaggcagttcagggtgtggcaagagcactacggtgcagctgatccagagactgtacgacccagatgagggcacaattaacatcgatggacaggacatccggaacttcaatgtgaactacctcagagagattatcggcgtcgtgagccaggagcctgtccttttttccacaaccatcgctgaaaacatctgctacggccgaggcaacgtgaccatggatgagatcaaaaaagcggtgaaggaagctaatgcctacgagttcatcatgaagctgcctcagaagttcgacacacttgtcggcgaaaggggagctcagctgtccggtgggcagaagcagcgtatcgcaattgctagggccctggtgcggaatcccaagatccttctacttgatgaagcaaccagtgctcttgatactgaatcggaggcggaggtgcaggccgccctggacaaggctcgggaggggcgtaccacgattgttatcgcccaccgattatcaacagtccggaatgcggacgtaatcgccggattcgaggatggcgtaatcgtggagcaggggagtcactctgagcttatgaagaaagagggagtgtactttaaactcgtgaacatgcagacatctggttcccaaatccaatcagaggaattcgagctcaatgatgaaaaagccgccacccgcatggctccgaatggctggaaaagccgattgttccggcacagtacccagaaaaatctcaagaattctcaaatgtgccagaagagtttggatgtcgagacggatgggttggaggccaacgtgccaccagtcagcttcctgaaggttttgaagctgaacaagaccgagtggccctatttcgtagtcgggaccgtatgcgccatcgctaatggcgggctgcagcctgccttctctgtgatcttcagtgagattatcgctatcttcggcccaggggacgacgctgttaagcaacaaaagtgcaacatcttctcattgattttcctgttcctgggtatcatttctttctttactttttttctgcagggcttcacattcggcaaggcaggtgaaatactgactcgacgcctgcggtctatggcattcaaggcgatgttaagacaggacatgagctggtttgatgatcacaaaaattccaccggagccctgtccacaaggctggcgaccgacgcagcacaagtccagggggccacggggacacggctggccttgattgcacagaacattgctaacttaggcaccggcatcatcatcagtttcatttacgggtggcagttgaccctcctgcttctggctgtggtgcctattatcgcagtatcaggaattgtggagatgaaactcctggctggtaacgcaaaacgggacaagaaagaactggaagccgctggcaagatcgccaccgaggctatcgaaaacatccgtaccgtggtcagcctgacacaggagaggaagtttgaatccatgtatgtcgagaaactgtacgggccatatagaaacagtgtgcagaaagcacatatctacggtatcaccttttcaatctcccaggctttcatgtattttagctatgcggggtgcttccgattcggcgcatacctcatcgtcaacgggcacatgcgttttagagatgtgattctggtcttcagcgcgatagtgtttggggccgttgccctggggcacgcttcctcttttgctcctgattatgctaaggcaaagctctccgcagcacatctgtttatgctgtttgaacgccagcccctaatagatagctattccgaagaggggcttaagccagacaagtttgaaggcaacatcaccttcaacgaggttgtgttcaattatccaacccgtgccaatgtgcccgtactgcaaggcctgagcttggaggtgaaaaagggccaaactctggcgcttgttggctctagtggttgtgggaagtccaccgtggtacaattgctcgaaaggttttacgacccgcttgccggcaccgtgctgctggatgggcaggaggccaaaaagctgaatgtacagtggttacgtgctcagttgggtatagtctcccaggaacccattctcttcgactgcagtatcgccgagaatatcgcctacggcgataattctagagtcgtgtcccaggacgaaatagtttccgccgccaaagccgcaaatattcaccccttcattgagactctgcctcataagtatgaaacacgtgttggcgataaggggacacaactgagcggaggccaaaagcaacgcattgccatcgcccgagcactcatacggcagccccaaatactgttgctggacgaagcaacatctgcactagatacagaaagcgagaaggtggtgcaagaggcactcgataaggcgcgcgaaggtaggacctgtatcgtcatcgcacaccgtctgagcactattcaaaacgcagacctcattgtcgtttttcagaacggaagagtcaaagagcacggtactcaccagcagctgctcgctcagaaaggaatttacttcagcatggtgagcgttcaggctggtactcaaaacctctag

SEQ ID NO: 2393 - DNA, 186 bp, Artificial Sequence
  Description of Artificial Sequence: Synthetic coding sequence
atggatctggaggcagccaaaaacggtacggcttggcgacctactagcgctgaaggggacttcgaactgggaatttcctcaaaacaaaaacgaaagaaaaccaagaccgtaaaaatgataggggtcctgactctgtttcgctattccgattggcaggacaagttgttcatgtcactcggcacatag

SEQ ID NO: 2394 - DNA, 3699 bp, Artificial Sequence
  Description of Artificial Sequence: Synthetic coding sequence
atggaccttgaagccgccaaaaacgggaccgcctggcggcccacttccgccgagggagattttgaacttggaatcagcagtaagcaaaaacgaaaaaaaacgaagacggtgaaaatgatcggagtgctgacactgtttcggtatagcgattggcaggacaagctgtttatgagtttaggaacgataatggccatcgcccatggcagtggcttaccactgatgatgatagtattcggagagatgaccgacaaattcgtggacaccgctggaaacttctcatttcccgtgaacttttctttgtccttacttaacccagggaaaatactggaggaggagatgacacgctacgcttactactatagcgggctgggcgctggcgtgctcgtcgctgcatacatccaggtgtccttttggacgctcgcagctggacgccagattaggaaaatccgccagaaattcttccacgcaatcctgagacaagaaattgggtggttcgacatcaatgataccaccgaactgaacaccagactgaccgacgacattagtaagatttccgaaggcatcggggataaagtggggatgtttttccaggcggttgccactttctttgccgggttcatcgtggggttcatccgaggctggaagcttactctggtgatcatggcgatatctccaattttaggactttcagcagccgtatgggccaaaattctatcagctttctccgataaagagcttgcagcctatgccaaagcaggcgctgtcgcagaagaagcattaggtgcaatcaggacagtaattgcattcggtggccagaacaaggaactggagcgataccagaagcatctggagaacgccaaggagatcggcattaagaaagccatcagcgctaatatcagcatgggaatagccttccttctcatctatgcttcctacgcgctggccttttggtacggctcaaccctcgtgatcagtaaggagtacacgatcggtaacgccatgactgtctttttctccatcttgattggtgctttcagcgtcgggcaggctgctccatgcattgacgccttcgcaaatgctcgtggcgccgcctacgttattttcgatattatagataacaaccccaagatcgattccttcagtgagaggggccataaacccgacagtattaagggcaacttagagtttaatgatgtgcacttttcttacccatctagagctaacgtgaagattctgaagggactgaacctcaaagtgcaaagcgggcagacagtggcgctagttggctcaagcggttgtgggaagagcaccacagtccagcttattcagcgcctgtatgatcccgatgagggcacaattaatatcgacgggcaagacattcggaactttaacgtgaattatctaagggagatcattggcgtggtctctcaagaacctgtgctgttttcaacaacaatcgccgaaaatatctgctacggacgcgggaacgtgacgatggatgaaataaaaaaagccgtcaaggaggctaatgcctatgagtttattatgaagctccctcagaaattcgacaccctagtgggggaaagaggggctcagctgagtggtggacagaagcagaggatagccattgccagagctcttgttaggaacccgaaaattttgctactcgatgaagccacaagcgccttggacactgagtctgaagctgaggtgcaggccgctctagataaagccagggagggacgcacgaccatcgtgatagcccaccgcctttccacagttcggaatgcggacgtgatcgccggattcgaagatggtgtaatcgtggagcagggatctcatagcgaattgatgaagaaagaaggagtctatttcaagctcgtgaacatgcagacctcaggctcccagatccagtctgaagagttcgaactgaatgatgaaaaggccgccacccgtatggctcccaacgggtggaaatcccggctttttaggcactctacgcaaaagaatcttaagaacagccagatgtgccaaaagtccctcgatgtcgaaacagacggcttagaagcaaacgtgcctccagtgtcatttcttaaggttctaaagctgaacaaaaccgagtggccttactttgtcgtgggcactgtgtgtgctatcgccaatggtggcctgcagcccgcctttagcgtcatcttttcggagattatcgccatcttcggacctggggatgatgccgtgaaacaacaaaaatgcaacattttctctctgatatttctgtttcttggaataatctctttttttaccttttttctgcaaggcttcaccttcggaaaagcaggcgagatcctgacgaggaggctgcgaagcatggcattcaaagctatgctccgtcaggatatgtcctggtttgatgaccacaagaactcaacgggcgctctgtcgacaaggttggcaactgacgcagctcaagttcagggagcaactggcacacgcttggctttgatagcccaaaatatcgcaaacttgggcacagggatcatcatatcatttatctacggatggcagttgacactgctgctgttagctgtggtgcctatcatagccgtctcaggtattgtggagatgaaattgctggccggtaacgccaaaagagacaaaaaggaattggaggcagccggcaagattgccactgaagcgatcgagaatattcgtacagtggttagcctgacacaggagcgtaagtttgaaagtatgtatgtcgagaagctatacgggccttatcgggtgttcagcgccatcgtctttggagcagttgccttgggccacgcttcttcattcgcccctgactacgcaaaggcgaagctatctgccgctcacctgtttatgctcttcgagagacagcctctgatagactcttattccgaagaaggcctaaagcctgacaagttcgagggaaatattacatttaatgaggtggtctttaattatcccaccagagctaatgtacccgtgctgcaagggctctcactggaggtaaagaaaggacagactttagccctggtagggagctctgggtgcgggaagagcactgtcgtccagctcctggaacgattctatgaccctctggccgggacagttcttctggatgggcaagaagcaaagaaactgaacgtgcagtggctgagggcacagcttggaatcgtgtcccaagaaccgatcctattcgactgttcaatcgcagaaaacattgcctatggagataattcgagggtagtgtcgcaggatgagattgtgagcgctgctaaagccgcaaacatccacccctttattgagacactgccccacaagtacgagacccgtgttggggacaaaggaacccaacttagcggtgggcaaaaacagcggatcgccatcgcccgcgcattgatccgacagcctcagatcctgctgctcgacgaggcaacctctgcactcgacactgaatctgaaaaggtcgtgcaggaagcacttgacaaggcacgcgagggcaggacatgtattgtcattgcccacagactgtccaccatccaaaatgccgatctaatagtggtcttccagaatggacgagtcaaggagcatggcacccatcagcagctactggcccaaaaaggcatatacttcagcatggtctccgttcaggctggcactcagaacctctag

SEQ ID NO: 2395 - DNA, 3840 bp, Artificial Sequence
  Description of Artificial Sequence: Synthetic coding sequence
atggatctggaggctgcaaagaacggcacagcctggcggcccacctcagccgagggcgactttgaacttggtatctcaagcaagcagaagcgaaagaaaaccaagacagtgaagatgatcggggttctaactctgttccgctactcagattggcaagataagctcttcatgtctctgggaacaatcatggccatcgcccacgggtctggcttacccttaatgatgatagtgttcggagaaatgaccgacaaatttgtggatacagctggaaatttctctttccctgtgaactttagcttgagcctacttaatcccggcaaaattctcgaggaagaaatgacacgctacgcatactactacagcggtctgggggccggcgtgctcgtcgcagcatatattcaggtgagtttctggactcttgcagccggacggcagattcggaagatacgacaaaaattctttcatgccatccttaggcaggagatcggatggtttgacattaacgataccaccgagctgaacacaagattgacggacgatatcagcaagatatcggagggtatcggagacaaggttggaatgttttttcaggcggtggcaacgtttttcgcaggcttcatcgtggggtttatccgggggtggaagctgactctggtgattatggcaatctctccaatcctgggactgagcgccgctgtgtgggccaagattcttagcgctttcagcgacaaggagctggcagcttacgcaaaggcaggagccgtcgccgaggaggccctcggggccattcggacagttatcgcttttgggggccagaataaagagctcgaacgataccagaagcatctggaaaatgctaaggaaattgggataaagaaagcgatctcggccaacatatccatgggcattgctttcctactcatttacgccagctacgcgctggcattctggtacgggtcaactctggttataagcaaggagtacaccataggaaacgccatgaccgtgttcttctcaatcctgatcggagcattttcagtcgggcaggcagcgccttgtatcgacgcattcgccaatgccagaggagcggcgtatgtgatatttgacattattgataacaaccccaaaatcgattcattcagtgagagaggtcacaaaccagacagcatcaagggcaaccttgagtttaacgatgtgcatttttcatacccctcccgggccaacgtgaagattctgaagggtctgaacctaaaagtccagagcgggcagaccgtagctcttgtgggctccagcggctgtggcaaatccactacagttcagttgattcagagactgtacgaccccgatgagggaacaattaatatcgacggccaagacatcaggaacttcaatgtcaattacctgagagaaattatcggggtcgtgagccaagaaccagttctgttctctactaccatagctgaaaatatttgctacggtcgagggaatgtgaccatggacgaaattaagaaggccgtgaaggaggcgaatgcctatgaattcataatgaaactgccccagaaatttgataccctggtcggagagcggggggctcagctgagcggtggccaaaagcagaggatagcaattgctcgggccctcgtcagaaaccctaagattctgctgctagacgaggctacttctgctttagacacagaaagtgaggcggaggtgcaggcggcactggacaaggcccgggagggacgaaccacaattgtgatagcccatagactgtccaccgtgcgcaatgcggatgtgatagccggctttgaggatggcgtgattgtcgaacagggcagtcacagcgagctgatgaagaaagagggagtttattttaagctcgttaacatgcagacatcagggtcccaaatccaatcagaggaatttgagttaaatgacgagaaggcagccacaaggatggcccctaatggatggaaaagccgactatttcggcattcgacccagaagaacctaaagaactctcaaatgtgccagaaatccctcgacgtcgagacagatggactggaagcgaacgtgccaccagtttcatttctaaaagtcttgaaacttaataagaccgagtggccatatttcgtggttggaaccgtgtgtgctatagcaaacggagggcttcagcccgctttctcggtgatcttcagcgaaatcattgcaatcttcgggcccggggacgatgctgtgaagcagcagaaatgcaacatcttttccctgatttttctatttctgggcataattagctttttcaccttttttctgcaggggtttactttcgggaaagcgggcgaaattctgactcgcaggttgcggtccatggccttcaaggctatgcttcgccaggacatgtcctggtttgacgatcacaagaacagcactggcgctttgtccacccgattagccacagacgccgcacaggtccagggggccaccggtaccaggctggccctcattgcccagaatatcgccaacctgggcaccggtattatcatttcattcatctacggctggcagctcacccttttgctgctcgcagtggtccccatcatcgcagttagtggcatcgttgaaatgaaactcctggccggaaacgccaaaagggacaaaaaggagctggaagctgctggaaaaatcgccacagaggctatcgagaatattagaactgtggtcagcctgacccaagagcgtaaatttgagtccatgtatgtggagaaactgtacgggccatataggaactctgtgcagaaggcccacatctatggaatcacattcagtatctctcaggcctttatgtacttttcctacgccggatgttttcggtttggggcttatctcattgtgaatggccacatgagatttagagacgttatattggtgttctcggccatcgttttcggggccgtcgcattagggcacgcgagttcattcgccccagattacgccaaggccaagctctccgcggcccatctgttcatgctgttcgaacgccagcctctgatagactcctacagtgaagaaggtttgaagccagataaattcgaaggcaacattacattcaacgaggtagtgttcaattatcctacccgcgctaacgttcctgtgctccaaggcctaagcctggaagtgaaaaagggccagacccttgccctcgtgggaagctctggttgcggcaaatcaacagtcgtccagctgctggaacggttttatgatccactagcaggcaccgtgcttctagatggccaagaggccaagaaattgaatgtccagtggttgcgagcccagctcgggatcgtgtcacaagagcccattctctttgattgtagcattgcggaaaatatagcctatggggacaactcccgtgtggtgtcacaggacgagatcgttagcgctgctaaagctgccaatatacatcccttcattgagaccctgccgcacaaatatgagaccagagtgggcgataaaggtacacagctttctgggggacagaaacaacgaatcgctattgcgagggccctgattagacagccccagattttgctcctggatgaagccacttctgccctggacactgaatctgagaaagtggtgcaggaggccctggacaaggcgagagaaggccgtacttgtatcgtcatcgcccaccggctgagtactattcagaacgcagacctgattgtggtcttccagaacggtcgggtcaaagagcacggcactcatcagcagttgctcgctcagaaaggtatttatttttctatggtgagcgtacaggcaggaacccagaatctgtag

SEQ ID NO: 2396 - DNA, 1464 bp, Artificial Sequence
  Description of Artificial Sequence: Synthetic coding sequence
atgcgagaaaacatggcccgcggcccctgcaatgcccctcgatgggcatctctcatggtcctggtcgcgatcgggaccgccgttacagcagcagtaaacccaggtgtggtggttagaatttcccagaaggggctggattacgctagccagcagggcaccgctgctctgcaaaaagaattgaagaggattaagatccccgattacagcgactcctttaagattaaacatttggggaagggccattattccttctatagtatggacataagggaatttcagttacctagcagccagatctcaatggtccccaacgtcggcttgaaattctccatctccaacgcgaacataaagataagtgggaaatggaaagcacagaagaggttcttaaagatgtctgggaacttcgatctctcaatcgagggtatgagcattagcgccgatcttaaattgggcagcaatcccacttcgggcaagccgacgataacatgtagctcctgttcctcccacatcaactcggttcacgtccacataagcaaatcgaaagttggctggctcattcaactttttcacaagaaaattgaatccgctctgcggaacaagatgaactcccaggtgtgcgagaaggtgactaactctgtgtctagtgaattacagccgtacttccagacactccccgtgatgactaaaattgattctgtcgctggaatcaattacggactggtggctccgcccgccacaactgcagaaacacttgatgtgcagatgaagggtgaattttattctgaaaatcaccacaaccccccgccctttgccccccctgtgatggaattcccggcggcccacgacagaatggtgtatctggggctgagcgattattttttcaataccgcgggcttggtgtatcaggaggccggagtattaaagatgaccctaagagacgatatgatccctaaggagagtaagtttcgcctgacaaccaagttcttcggtacatttttgcccgaggtggcgaagaagttccccaacatgaaaatacagattcacgtttccgccagcacacctccgcacctgagcgtgcagccgacaggtttaacgttctatccagcagttgacgttcaggcatttgcagttttgcccaatagtagcctggcaagtctgttcctgattggaatgcacaccactgggagtatggaggtgagcgcagagtcgaaccgcttggtcggcgaactcaagctagaccgcctgttgctggagctcaagcatagtaatattggacccttccctgttgaactgcttcaggatattatgaactacatcgtccctatcctcgtcctccctcgcgtgaacgagaaactccaaaagggctttcccctgcccactccagctagagtgcagctctacaacgtggtgttgcagcctcatcaaaatttccttctgttcggtgccgacgtagtctataaatag

SEQ ID NO: 2397 - DNA, 1449 bp, Artificial Sequence
  Description of Artificial Sequence: Synthetic coding sequence
atggatgagggtatcccccatctgcaggagcggcagttgcttgaacatcgggatttcatcggcttggactatagtagtttatacatgtgcaagcccaaaaggagcatgaaaagagatgacacgaaggacacctacaagctaccccacaggttaatcgagaaaaaaagacgggatcggattaatgagtgtattgcacagcttaaagacttgctccctgaacatctgaagctgacaaccctgggacatcttgagaaggcggttgtccttgagctgacgctcaagcatctgaaggcactgacggccctgaccgagcaacagcatcagaaaatcatcgccctccagaacggggagcggtcgctgaagagccccatccaatcagacctggatgcctttcattcaggcttccaaacatgtgcaaaagaagtgctgcaatatcttagccgattcgagtcttggactcctcgggaaccccgctgcgttcagctcattaaccacctccacgccgtagccactcagtttctacccaccccccaattattaacacagcaggtgcccctgtcaaagggtacaggagcccccagcgcagcaggtagtgcagccgcaccatgcctggaaagagcgggacaaaagctggagcccttggcgtactgcgttcccgtcatccaaagaacccagccatccgctgagctggccgctgagaacgatactgataccgattctggttacggaggcgaggctgaggctagacctgaccgagaaaagggcaaaggggctggcgctagcagagtaaccattaagcaagaacctcccggagaggactctcctgccccgaagaggatgaaactggattctcgaggtggcggttccgggggtggcccaggcggaggagccgctgcggcggccgctgccctgctcgggcctgaccctgctgcagcggcagcgctcctgcgccctgacgcagccctcctttcgtctcttgtagcgttcggcggcggcggcggagccccattcccccagcccgcggctgccgcagctcctttctgcctcccgttttgttttctcagtccctctgccgccgccgcttacgtgcagccattcctggacaagtcgggattggagaagtatttataccccgctgccgccgccgctcctttccctctactatatccaggaatccctgcccccgccgcggcagctgccgccgccgccgccgctgctgccgcagctgccgcgttcccatgccttagcagcgtgttgtcccccccccccgagaaagccggcgctgctgctgctacattgctgccacatgaagtggctccccttggagctcctcacccacagcacccccatgggcgcactcatctgccctttgccggcccacgggagcctggcaaccccgaaagcagtgcccaggaggatccttctcagcccggtaaggaagctccctag

SEQ ID NO: 2398 - DNA, 1113 bp, Artificial Sequence
  Description of Artificial Sequence: Synthetic coding sequence
atggatgaaggaattcctcacctgcaggaacgtcagctattagagcatagggattttattggtcttgactatagctccctgtacatgtgcaaacctaaacgctctatgaaacgggatgatacaaaggacacctataagctaccccacaggctgatcgaaaaaaagcggcgcgaccgtattaatgaatgtatagcccagctgaaagacttgctacccgagcacttaaagctgactaccctgggacacctcgagaaagcagtcgtgctggagctgaccttaaagcacctcaaggcactgaccgctttgacggaacagcaacaccaaaagatcatcgctttacagaacggggagcgcagcctgaaatcccctatccagtctgatctagacgccttccattcgggcttccagacctgcgccaaggaagtacttcagtatctcagccgcttcgaatcatggacacctcgagagcccagatgcgtgcagcttataaaccacttgcatgcagtcgccacgcaatttctccctacgccccaactcctaacccagcaagtgcctttatctaaaggcactggggcccccagcgccgccggaagcgcagctgcaccctgtcttgaacgggctggacagaagcttgaaccacttgcctattgtgtcccagttatacagcgtacacagccgagcgctgaactagcagccgagaatgacacagatacagatagtgggtacggcggagaggccgaagcacgacccgacagggagaaggggaagggtgccggggcttccagagtgacaattaaacaggaacctccaggcgaggacagcccacctcccccacctcggagccctgcttgcccaaggtgctgtaggcctctccctaggcggagggcgcctcctccaaggcctagttgccggacccggtggagaccgttagggagacgcaccccctcgacacgaacagcggcccctacttgtcctagtcccggcccggcctcaaggggcacacgcagggccttgcttaggaaaattccgaggtcccaggaaagaaaactgcctgagtcactgcgtcctgaagggcggcgctttaagcagtcagagaaactcaaatatccctag

SEQ ID NO: 2399 - DNA, 1191 bp, Artificial Sequence
  Description of Artificial Sequence: Synthetic coding sequence
atggtggcaggcactaggtgtctcttggccctgcttctgcctcaagttctcttaggcggcgcagctggtttggttcccgagctgggacgcagaaaatttgcagcggccagcagtggcagacctagttcccagccgagtgatgaggtgctgtctgaatttgagctgaggctgctgagcatgtttggcctcaagcagcgtcctactcctagtcgagacgccgtggtgcctccatacatgctcgatctgtatcggaggcactctggccagcccgggagccccgcaccagaccaccggctcgagagagctgcctcaagagctaatacagtccggtcctttcaccacgaagaaagcttggaagagctgccagaaaccagcggtaagactactagacgcttcttcttcaacctgtcttccatccccaccgaggaattcataacgtccgcagaactccaggtcttccgcgagcagatgcaggatgccctcgggaataactctagcttccaccaccgcattaatatttatgagataataaaacctgccaccgcgaacagcaagtttccggtgactcgacttttggataccagacttgtgaaccagaatgcatcaaggtgggagagtttcgacgtcacccctgccgttatgcggtggactgcgcagggacacgcaaaccacgggtttgtggtggaagtagcacatctggaggagaagcagggcgtgtccaaacggcacgtgcggatctcacggagtctgcaccaggatgagcattcctggagccagatcagacccttgctggtcacgttcgggcacgatggaaagggacatccactgcacaagagggaaaaacggcaggcgaaacacaagcagaggaagcggctcaaatcctcctgcaaacggcatcctctgtacgttgacttctccgatgtggggtggaatgactggatcgtggcgccgccgggttatcatgcattttactgtcacggggaatgcccattccctcttgctgatcatctcaacagcactaatcatgcaattgtccagacgctggtgaattccgtgaattctaagatccccaaagcatgctgtgtgccgaccgagctgtcagccatatcaatgctgtacttggatgaaaatgagaaggtcgtgctgaagaattaccaggacatggtagtggaagggtgcggctgcagatag

SEQ ID NO: 2400 - DNA, 1296 bp, Artificial Sequence
  Description of Artificial Sequence: Synthetic coding sequence
atgcacgtgaggtccctgagagcagcagcaccccacagcttcgtggcgctttgggcaccattgttcctcctccgttccgcacttgcggacttctccctggacaatgaggtgcattcttcgtttatacaccgacgcctccgttcccaggagcgccgggagatgcaaagagaaattcttagtattcttggcctgccacacagaccccggccacacctgcagggaaagcacaactctgccccgatgttcatgttagatctatataacgctatggctgtagaagagggcgggggtcctgggggacaagggttttcgtatccatacaaggcagtcttctccacccaaggaccaccactcgcctctctgcaggacagtcacttcctgacagacgccgacatggtcatgtcctttgttaacctggtggaacacgataaagaattcttccatccccggtaccatcaccgcgaatttcgttttgatctctcgaagattcctgaaggggaggcagtgactgcagcggagtttcgcatttacaaagactacattagggagcgctttgataacgaaacatttaggatcagcgtgtatcaagttctccaggagcacctaggccgagagtctgatctgttcctgctggattccagaacactctgggccagcgaggaggggtggttggtgtttgacataactgccacctccaaccactgggttgtgaacccaagacacaacctgggtcttcagctcagcgtcgaaaccctggacggacagagcataaatcctaaattagcagggctcattgggaggcatggacctcagaacaagcagcccttcatggttgccttctttaaagctactgaagttcacttcaggtccatcagatctaccggttctaagcaacgctcccagaaccgcagcaaaacccctaaaaatcaggaggcactaagaatggcaaacgttgccgaaaacagctctagcgatcagcgccaagcctgcaaaaagcacgaactttacgtgagctttagggacctcggctggcaggattggattatcgcaccagagggatacgctgcttactattgcgagggtgaatgcgcatttccactgaatagttacatgaatgctacgaatcacgctatcgtccagacactcgtacacttcataaaccccgagaccgtacctaagccatgttgtgccccaacacagctgaacgcaatttctgtgctatatttcgacgatagcagtaacgtcatcctaaagaaatatcggaatatggtggtgagggcctgtggctgccactag

SEQ ID NO: 2401 - DNA, 1098 bp, Artificial Sequence
  Description of Artificial Sequence: Synthetic coding sequence
atgcatgtgaggtctctgagggccgccgccccccactcatttgtcgccctgtgggccccgctgttcctgctccgatccgcccttgcagactttagcctggacaatgaggtgcacagcagttttatccatagaagactgcggtctcaggagcggagagagatgcaacgcgaaattttaagcattctggggctgccacacaggcctcgcccccacctacagggaaagcataatagcgcgcccatgttcatgctcgatctgtacaacgccatggccgtagaggaagggggcgggccagggggccagggattctcatatccctataaggccgtcttttctactcaggggccaccacttgcctcactccaagactcccacttcctaacagatgccgatatggtaatgtccttcgtgaacttggtggagcacgataaggagttcttccatccacgttatcatcatcgcgagttccggtttgacctgagcaagatacccgagggcgaggctgtgaccgcggctgagtttaggatctataaggactatatccgagagcggtttgataatgaaacattccggattagcgtttatcaagtgttacaggagcatttgggaagggaatctgacctattcttgttagatagcaggacgctctgggctagcgaagaaggctggcttgtgttcgacatcaccgccacgtcaaatcactgggtcgtgaacccaaggcataatttggggcttcagctgtccgtcgagactttggatgaaaatagctccagcgaccaacgtcaggcttgcaagaaacatgagctgtacgtgtcattccgtgatcttgggtggcaagactggattattgcacctgagggctatgccgcttactactgcgagggcgaatgtgctttcccgctaaatagttatatgaacgctactaaccacgccatcgttcagacacttgtgcactttatcaatcccgaaaccgtccctaaaccatgttgtgcccccacccagctgaatgctatatccgtgctttatttcgacgactcttccaacgtaatcctgaagaagtatcgcaacatggtcgtgcgagcctgcggttgtcattag

SEQ ID NO: 2402 - DNA, 1656 bp, Artificial Sequence
  Description of Artificial Sequence: Synthetic coding sequence
atggcaggtgacctgagtgctgggttcttcatggaagagctgaacacctataggcagaaacaaggggtggtgctcaaatatcaagagctgccaaatagcggacctccacacgatcggcgttttacgttccaagtgatcatcgacggccgcgaatttccagaaggggagggacggtccaaaaaggaggccaagaatgccgccgcgaagctagctgtcgaaattttaaacaaagaaaagaaggcggtgtcgccacttctgctgacaacgaccaacagcagtgaaggactgagcatggggaattacatcgggctgataaatcggatcgcccaaaagaaaagactcacagtgaactacgagcagtgtgcttctggcgtacatggccctgaagggttccactacaagtgcaagatgggccagaaagaatacagcatcggcacaggctcaactaagcaggaagctaagcagttggctgcaaagctagcttatttgcagatcctctctgaagagacttccgtgaaatcagactaccttagttcaggctctttcgccaccacctgtgagtctcagagcaactctctcgtgacatccacacttgcaagcgaaagttcctccgagggagattttagcgccgatacaagcgagattaatagcaatagcgattctctgaacagcagcagcttactgatgaacgggctccgcaacaatcagcggaaggccaagaggagccttgcaccacgctttgacctaccggacatgaaggaaactaaatataccgtggacaaacgtttcggaatggatttcaaagagattgaactcatcgggagtggcgggttcggccaggtgtttaaggcaaagcaccggatagatggaaaaacatacgtcattaaacgtgtgaagtacaacaatgaaaaagctgaacgggaggtaaaggctctcgccaagctagaccacgttaatatcgttcactataacggctgctgggatggcttcgattatgatccagagacttcagatgactctctggaatctagtgattacgatccagaaaatagcaaaaatagcagccgcagcaaaaccaaatgccttttcatccagatggaattttgcgacaagggcaccctagagcagtggattgagaaacgacgaggcgagaagctggacaaggtgcttgcattggagctatttgaacaaattacgaaaggagtggattatatccactccaagaagctcatccacagggatcttaaaccctcaaatatcttcctcgtggacaccaagcaggtgaaaatcggcgattttggcttagtgacctctctcaagaacgatggcaagcgcacacggtcaaaaggcaccctgcgctacatgagccccgagcagatctcttctcaggactacggaaaggaagtggacctctatgcgctgggcctgatccttgccgagctgcttcacgtgtgcgatacagccttcgaaaccagtaagttttttactgacctgcgggacggcattatatctgatatcttcgataagaaggaaaaaactctactgcagaaattgctcagcaagaagccagaggacagacccaacacatctgagatcctaagaactttaactgtgtggaaaaagtctcccgagaagaacgagcggcatacatgttag

SEQ ID NO: 2403 - DNA, 366 bp, Artificial Sequence
  Description of Artificial Sequence: Synthetic coding sequence
atgaccaggatcctcacagccttcaaggttgtcaggaccctgaaaaccggcttcggtttcaccaacgtgaccgcccaccagaagtggaagtttagccggccagggatcagactgcttagtgtcaaggcccagacagcacatatcgttttagaggatggcactaagatgaaaggttacagtttcgggcacccctcctccgtggcgggagaagtcgtctttaacacgggcctagggggctatccggaggctataacagacccagcgtataagggacagatactcaccatggccaatccaattatcgggaacggtggagcacctgacacaactgctttggacgaattgggtctgtctaagtatctgtag

SEQ ID NO: 2404 - DNA, 4521 bp, Artificial Sequence
  Description of Artificial Sequence: Synthetic coding sequence
atgccccagataataaaaatgacaagaatattaaccgcatttaaggtagtccgtacactcaagactgggtttggttttacaaatgttacagctcaccaaaaatggaagttcagcaggcctgggattcggttgctgagtgttaaagcccaaacagcacatattgtgctggaagacggtactaaaatgaagggatactcttttggccacccatccagcgttgcaggtgaagtggtgttcaatactggcttgggggggtacccagaggcgatcaccgacccagcttacaaaggccaaattctcaccatggcaaatcctatcataggaaatggcggagcccctgataccaccgccctcgacgaacttgggctgtccaaatacctggaatcaaatggcatcaaagtttctgggctgctagtattggactatagcaaagattataatcactggctggctactaaatcactggggcagtggctacaggaagagaaagtgccagcaatttacggtgtggatacccgtatgctgaccaaaatcattcgcgataagggtaccatgcttggcaagatcgaattcgaaggtcagcctgtggacttcgtggaccccaacaagcagaatctcattgctgaggtgtccaccaaagacgtcaaggtttacgggaaggggaatcccacaaaagtcgttgccgtagactgtggaattaagaataatgtgatccggctactggtaaagcgaggtgccgaagttcacctggtcccttggaaccacgatttcaccaaaatggagtacgacgggatcctgatagccgggggccctgggaatcccgcgctggccgagcccctgatccagaatgtgaggaaaattctcgaatcggacagaaaggagcccctgttcggcatctctactggaaacctgattaccggactggcagccggagccaagacttataaaatgagcatggccaacagaggacagaaccagcctgtcctgaatattactaataaacaggccttcattacagctcagaatcatggctacgctctggataatacactcccggctggctggaagccactgttcgtaaatgttaatgatcagaccaatgagggtatcatgcacgagagcaaaccctttttcgctgtgcagttccaccccgaagtcactcccggccccatcgatactgagtacctctttgactcattcttctcactcatcaagaagggcaaggccaccaccattactagtgttctgccgaagcccgcgttggtagcgagccgggttgaagtgagtaaagtgctgatactgggctccgggggactcagcattggtcaggctggtgagttcgattacagcggcagtcaagctgtgaaagcaatgaaggaggaaaacgtgaaaacggttctgatgaaccccaacatagcaagcgttcagaccaacgaggttggccttaagcaggctgacacggtctactttcttccaattacaccccagtttgtgacagaggtaataaaggctgagcaacccgatggactgattttgggcatgggaggccaaacggcgctgaactgtggcgttgaattattcaaaagaggcgttctcaaagagtatggcgtgaaagtgctcggaacgtccgttgaaagtatcatggccaccgaagacagacagctcttttccgataagctgaatgaaataaacgaaaaaattgctccctccttcgctgtggaatctatcgaagacgctctcaaagccgctgacactatcgggtaccccgtgatgattaggtcagcttacgcgctcggtggcttaggaagcgggatctgtcccaatcgggagactctgatggatctctcaactaaagcttttgctatgacgaatcaaatactggtcgagaaatcagtgactggatggaaagagattgaatatgaggtggtgcgtgacgctgatgataactgtgtaaccgtgtgcaacatggagaacgttgatgcgatgggggtccatactggggatagcgtggtagtggcacccgcgcagaccctgagcaatgctgaattccagatgttgagacgaacaagcataaatgtagtccgccatcttggtattgtcggcgaatgtaatatccaatttgcgctgcaccccacctcaatggagtattgcattatcgaagtaaatgcaaggctctcaagaagctccgccctcgccagcaaagccaccggttatccattggcctttatcgcagccaagatcgccctgggcatcccactaccggaaataaaaaacgtggtgtccggaaagacatcggcatgctttgaaccctcacttgattacatggttactaaaatcccacgatgggacctggacagatttcatgggacttcaagtcgcatcgggagctctatgaagagcgtgggggaggtcatggctatcggccggacctttgaagagagcttccagaaggctttacggatgtgccatccgtccatcgagggtttcaccccacgcctacccatgaataaagaatggccatctaacctcgatcttcgaaaggaattgtcagagccatcatccacccgcatatatgccattgccaaggcgattgacgataacatgtctctcgacgagatagaaaagctgacctatatagacaagtggtttctgtacaaaatgcgtgacatccttaacatggagaaaactcttaaggggctgaattctgaatcaatgactgaggaaacactcaaacgggccaaggaaatcggatttagtgacaagcaaataagcaaatgtctcggcctgacagaggcacagacccgagaactgcggcttaaaaaaaacatccatccttgggtgaagcagatcgatactctggccgctgagtatccaagcgtgacaaactacctgtatgttacttacaacggccaggaacatgatgtgaacttcgatgaccacggtatgatggtgctcggttgtggcccgtaccatattgggtcaagtgtagaattcgactggtgcgctgtctcttccattaggaccctgcgacagttggggaaaaagactgtggtggtcaactgtaaccctgagaccgtctctactgatttcgacgagtgtgataagctgtactttgaagagctctcgttagagcgcatcctcgatatttaccatcaggaggcctgcggtggctgcattatctccgtcggtggacagataccgaacaatctggccgtgcctctatataaaaacggtgtgaagatcatggggacttccccacttcagatcgacagggcggaggatcgaagtatttttagcgcagtcctcgacgagctgaaagtggctcaggcaccctggaaagctgtaaacaccctaaatgaagccctggagttcgccaagagcgtggactacccttgccttcttaggccttcttatgtactgtccggcagcgccatgaacgtcgtgttcagtgaagatgaaatgaagaagttccttgaggaggcgaccagggtgagccaggagcaccccgtcgtactgacgaaatttgtagaaggcgcaagggaggtcgagatggatgccgtgggcaaggatggaagggtcatcagccacgccatctccgaacacgtggaagatgccggggtgcacagcggagatgcaacattgatgctgccgactcagaccatctcgcaaggggctattgagaaggtgaaggacgcaaccagaaagatcgccaaggcctttgccatcagcggaccttttaatgtacaatttctggttaagggaaacgatgtcctggtcatagagtgcaacttaagagcctcacggtcctttcctttcgtctcgaaaaccctgggagtagacttcattgatgtggcgacgaaagttatgatcggagaaaatgtggatgaaaagcatctgccaaccttggatcaccctataatccctgctgattatgtggctatcaaggcccccatgttttcctggcccagattgcgggacgctgaccccattctgaggtgcgagatggcctcaacgggcgaggtcgcctgttttggcgagggtattcatacagcattcctcaaagccatgttatccaccggattcaagattcctcaaaagggcattctcattggaattcagcagagttttcgaccacgctttctgggcgtggctgagcagttgcataacgagggctttaaactcttcgcaaccgaagctacctccgattggttgaatgctaacaacgtacctgctacccccgtagcttggccttcacaggaagggcagaatccatccctgagcagcatcaggaagcttatccgagacggctctatagatctcgtgattaacttgcccaacaataataccaagtttgtccacgacaactatgtcatccgacgcaccgccgttgattcgggaatcccactgcttacgaacttccaggtgacgaaattgtttgccgaagccgttcagaagtcccgcaaagttgactcgaagagcctgttccactacaggcaatatagtgccggaaaggctgcatag

SEQ ID NO: 2405 - DNA, 3150 bp, Artificial Sequence
  Description of Artificial Sequence: Synthetic coding sequence
atgaaagaggagaatgtcaagacggtcctgatgaatcccaacattgcttccgtccaaacaaatgaagtgggccttaaacaggccgatacagtctattttctgcctatcacccctcagtttgtcaccgaggtgatcaaagcagaacagccggacgggttgatcttaggcatgggcggccagaccgcgctcaactgcggggtggagctgtttaagagaggggtcctcaaagagtacggggtgaaggtgttggggacatctgttgagtcaattatggctacagaggacagacagctgttctccgacaagctgaacgagattaatgagaagattgcaccgtcttttgccgtcgagtcgattgaggacgcattgaaggccgcggacacaattgggtatccagttatgattcgatccgcctatgccctgggtggactggggtctgggatttgtcccaatcgcgagacactgatggacctgagcaccaaagccttcgctatgaccaaccaaatacttgtggaaaagagtgttaccgggtggaaagagatcgagtatgaagtcgtccgcgacgcagatgacaattgcgtgactgtgtgtaacatggaaaacgtggacgccatgggcgtccacacgggcgactctgttgtcgtcgctcctgctcagaccctcagtaatgccgagttccagatgctgaggcggacctccataaacgtggtgaggcacctggggatcgtcggcgaatgcaatatccagttcgctcttcaccccacctcgatggagtactgcatcatcgaagttaatgcccgcctgagtcggtcatccgctctggcgagcaaagcaactggataccctctagctttcatagcggcaaaaatcgcactagggatacccctgcccgagatcaagaatgtggtttcagggaaaactagcgcctgttttgagcctagtctggactatatggtgacgaagatcccccgctgggatttagatcggttccatggtacatcatccagaattggaagtagtatgaagagcgttggcgaggtaatggctattggccggaccttcgaagaatcctttcagaaggccctacgaatgtgtcacccaagtatcgagggctttactcccagactgcctatgaataaggagtggccttccaacctggacttgcggaaggaactctccgaaccatcttctaccaggatttacgcaatagccaaggcaatagacgacaatatgtcactcgatgagatcgaaaagttgacctatatagataaatggtttctttataagatgcgggacattttgaacatggagaagacactcaagggtctaaattctgaatctatgaccgaggagaccctgaagcgcgccaaggagatcggcttcagcgacaagcaaatctctaaatgtcttggacttactgaggcacaaacccgggagctgaggctgaaaaagaatatacacccctgggttaagcagattgatacacttgccgctgagtaccccagcgtcaccaactatctgtatgtgacttacaacggtcaggagcatgacgtaaatttcgatgaccacggcatgatggtgttgggctgcggaccctaccacattgggagctccgtggagttcgattggtgtgcagtctcatccattaggactcttcgtcagctcgggaaaaagacagtcgtggtaaattgtaaccccgagacagtcagtaccgatttcgacgagtgcgataagttgtactttgaggagctgtcactggagagaatcctagatatctaccatcaggaagcctgcggggggtgtatcatctccgtcggcggccaaatccctaataacttggcagtccccctgtacaaaaacggggtgaaaatcatgggaacttcccccctgcaaatcgacagagccgaggaccggagcatcttttcggctgtgttggacgagctgaaagtggcgcaggccccctggaaagccgtgaacacactaaacgaagcacttgaatttgcaaagagtgttgattatccttgcttgcttcgcccctcttatgttcttagcggatcggccatgaacgtggtgttcagtgaagacgagatgaaaaaatttctggaggaggcgactcgggtctctcaggaacatcctgtcgtcctgactaagttcgtggagggagccagggaggtcgagatggatgccgttggcaaggacggccgagtgattagtcacgccatatccgagcacgtagaggacgcgggcgttcactccggcgacgctaccctgatgctgcccacacagaccatcagccagggtgccatcgagaaagtgaaagatgcaaccaggaagatcgccaaagcattcgctatcagcgggccattcaacgtccagtttttggtcaagggaaacgacgtgcttgtcatcgagtgtaacctgcgagctagccggtcatttccgtttgtgtcaaagacactaggggttgatttcattgacgttgccaccaaggttatgataggggagaatgtggacgagaaacatttgccaacacttgatcacccaatcatcccagccgattacgtggcaattaaggcacccatgttctcatggcctagattgagagatgctgaccctatactgcgatgcgagatggcctccacaggtgaggtggcttgctttggagaagggattcatacagcctttcttaaagccatgttaagcacggggtttaagattccacagaagggcattctcatagggattcagcagtcattccgcccgcgcttccttggggtggcggagcaattacataacgaaggctttaagctcttcgcgaccgaggcgacaagcgattggctgaacgccaacaacgttcctgctaccccagtggcatggccatctcaggagggacaaaatccttctctgtcttcgatccgcaaactgatccgcgatgggtccatcgatttggtgattaatctgccaaacaacaacaccaaattcgtgcatgataactacgtaataagaaggacagccgtagactcaggcataccgcttctgacaaactttcaggttacgaaactttttgctgaggcggtgcagaagtcccggaaggtggattccaagtctctgttccattatcgccaatattctgctggaaaggcagcatag

SEQ ID NO: 2406 - DNA, 366 bp, Artificial Sequence
  Description of Artificial Sequence: Synthetic coding sequence
atgactcgcatacttacagcattcaaggtcgtgcgaacactgaagactggtttcgggtttacgaatgtcaccgctcatcagaagtggaagttcagccgaccaggaattcgcctgctatccgtaaaggcgcaaacggcccacatcgtactcgaggacgggactaaaatgaagggatactctttcggtcacccaagcagcgtggctggagaggtagtcttcaacacaggccttggaggctaccctgaagccataactgatcccgcctacaagggccagatactcaccatggcaaatccaataattgggaatggcggcgcccccgacactaccgccttggacgagttaggtctgagcaaatacctgtag

SEQ ID NO: 2407 - DNA, 1542 bp, Artificial Sequence
  Description of Artificial Sequence: Synthetic coding sequence
atgacacgtatcctgactgcgttcaaggtggtgcgcacgctcaaaactggattcggattcaccaacgtgaccgcacaccaaaagtggaagttcagccgtccgggtatcagactgctgtccgttaaggctcagactgcacacattgttttggaggatggcaccaagatgaagggctattcttttggacacccttcttcagtcgcgggcgaggtggtgttcaataccggactgggagggtatcccgaggctattacggaccccgcttataaaggtcagatccttactatggccaatccaattattggtaacggcggcgcgcccgataccacagcattggacgagttgggactcagtaagtacctcgagagtaacggcattaaagtgtcaggactgctggtgttggactattcaaaagactataaccactggcttgcaacaaagtctctcggccagtggctacaggaagagaaggtgcccgccatttatggagttgatactcggatgctcaccaagataattcgggataaaggcacgatgttgggtaaaattgagttcgaaggacaacccgtggattttgtggatcccaacaagcaaaacctaattgcggaagtctcgacaaaagatgtcaaagtgtatggcaagggcaatcccacaaaggtggtcgctgtggattgtggcattaagaataatgttattcgactgcttgtcaaaaggggtgctgaagtacacctcgtcccctggaatcatgatttcaccaagatggaatatgatggcatccttatagctggcggtcccggtaatccagccctcgccgagccattgatccagaacgtgcgaaaaattctagaaagtgataggaaggagcccctgttcgggatctctaccggaaatctgatcacaggcctggcagccggggctaagacttacaagatgagtatggcaaatcgtggccaaaaccagcctgtcctaaacatcacaaataaacaggcctttatcaccgcgcagaaccatggttatgccctcgacaatacccttccggctgggtggaagcctctcttcgttaacgttaacgaccagacaaatgaaggaatcatgcacgaaagcaagccgttttttgcggtgcagtttcatcctgaggtgacgcccggaccaattgacaccgagtacctgttcgattcatttttctctctcatcaagaaggggaaagccaccactattacatccgttttgcctaagcctgcccttgtggccagccgcgttgaggtgagcaaggtgctgatattgggctcaggcggtctcagcatcgggcaggctggggagttcgactactctgggtcccaggccgtgaaggctatgaaggaagagaatgtcaagactgtgctcatgaacccgaacatagccagtgtgcagaccaatgaagtaggtttgaagcaggccgataccgtgtacttcctgccgattacaccccagttcgtcaccgaggttataaaagctgaacagcccgacggtcttatcctgggtatgggagcacgccagttgtag

SEQ ID NO: 2408 - DNA, 4527 bp, Artificial Sequence
  Description of Artificial Sequence: Synthetic coding sequence
agacccagaccacagataatcaaaatgacacgcatcttaactgcgttcaaggttgtgaggacactgaagactgggtttggtttcacaaacgttactgcccaccagaaatggaagttttccaggcccggaatacgactcctcagcgtgaaagcccaaaccgcccatattgtactggaagatgggactaagatgaagggttactcctttggacacccaagctccgttgcgggcgaagttgtttttaacacaggattgggaggctaccctgaggctataacagaccccgcctataaggggcagatactgacaatggcaaaccctatcattggaaatgggggtgctccagataccaccgccctggatgagctcggcctctctaagtacctggaatccaatggcattaaggtgagtggactgctagtgttggactacagtaaagactacaaccactggcttgctacaaaatctctgggccagtggttgcaggaagagaaggtaccagcaatttatggggtggatactcggatgctgacaaagattattagggataaaggcactatgttgggaaagattgaattcgaagggcagcctgtggactttgtggaccccaataaacagaacctcattgccgaagtgtcaactaaggacgtgaaagtatacggaaaaggtaaccctaccaaagtggtggccgttgattgcggcattaaaaacaatgtgattcggctgcttgtcaaaaggggcgctgaagtgcatctggtaccctggaatcatgacttcacgaaaatggaatacgacggtatcctcatagccggcggaccgggcaatccggctctggctgaaccactcatccagaatgtccggaaaatcctcgaatctgatcgtaaggaacccctgtttgggatctccacagggaatctgattaccggactcgccgccggcgccaagacctacaagatgtctatggccaaccgcggacagaatcagcctgtgctgaatatcaccaacaaacaagctttcataaccgcccaaaatcacggctatgctctggataacaccttgcccgcaggctggaagccgctgttcgtgaacgtgaatgaccaaactaatgagggcatcatgcacgagtctaagccgttcttcgccgtccagttccaccccgaggtcacacccgggccaatagatactgaataccttttcgactccttttttagcttgattaaaaaagggaaggccaccacaataacatcagtccttccaaagcccgcgcttgtcgcaagtagagttgaggtcagtaaggtactgatactagggtctgggggcctaagcatagggcaggctggggaattcgattatagtggttcccaggcagttaaagcgatgaaggaagaaaacgtgaagactgttctcatgaacccgaatattgcctcagtacagaccaacgaggtgggcttgaaacaggcagataccgtctatttcctgccaatcacaccacagtttgtaactgaagtgatcaaggccgagcagccagatggtctgatcctggggatgggcggtcaaactgcattaaactgcggggtcgaactattcaaaaggggcgttctgaaggaatacggtgtgaaggttttgggcacttctgtcgaatccatcatggccaccgaagataggcagctattctctgataaactcaatgagattaatgagaagatcgcccccagctttgctgtcgaaagcatcgaagacgccttgaaggccgccgacaccataggatatcctgtgatgatcaggtctgcgtatgccttgggggggttgggatcaggaatttgtcctaatcgcgagactctgatggatctctccacaaaagcattcgccatgaccaatcagatcctggtcgaaaaatcagttaccgggtggaaggagatcgagtatgaggtggtccgggacgccgacgataactgcgtcacggtgtgcaatatggagaacgtcgatgctatgggagtccatacaggagattctgtggtggtagctccagctcagacactgtccaatgctgaattccagatgctcagaagaacctctattaacgttgtcaggcatttggggatcgtgggagagtgcaatattcagttcgccctgcaccccacaagcatggagtattgtatcatagaggtgaatgccaggttgtccaggagttccgcgctagcctcaaaagccaccggatatccattggcatttattgctgccaaaatcgctctcggtattcccctgccggaaataaaaaatgtggtgtccggaaaaacctccgcttgctttgaaccttccctcgactatatggtgacaaaaatcccaagatgggatctcgataggttccatggaacatctagtcgaatcggctccagcatgaagagcgtcggtgaggtgatggccatcggtaggacattcgaagagagcttccagaaggccctccggatgtgccatccgtctatcgagggtttcacgccccgactgcccatgaataaggaatggcccagtaatctcgaccttcggaaggagctgagcgagccctcttctactcggatctatgccattgcaaaggcaatcgacgacaatatgagcctcgatgagatcgaaaagcttacatatattgataagtggtttctttataagatgagagacatcctgaacatggaaaaaacactcaagggcttgaactccgaatctatgaccgaagaaaccctaaaaagagcaaaagagattggcttcagcgataagcagatctctaaatgtttaggattgacagaagctcagacccgcgagctgcgcctgaagaagaatatccacccatgggtcaagcaaatcgacactctggcagcagaatatcccagtgttaccaattacctctatgtgacctacaatggacaggaacacgatgttaattttgacgaccatggcatgatggtgctgggatgcggcccttatcacatcggatccagcgttgaattcgactggtgcgccgtgagctccattcgtacgctgcgccaactcggaaagaagaccgtcgttgtgaattgcaaccccgaaaccgtgtcgactgactttgacgagtgcgataaattgtactttgaagagctgtcactggaacgcattctggacatctaccatcaagaggcatgcggggggtgtatcatcagcgtaggtggccagattcccaataacttggctgtaccgctgtataagaatggtgttaagataatgggcacttccccccttcagattgacagagccgaagatcgatcaattttttccgcggtgttagacgaacttaaggtggcccaggctccttggaaggccgtgaacacgctcaacgaagctctagagttcgcaaaaagcgttgactacccctgcctgctgcgaccctcctacgtcctgtccggaagtgccatgaatgtggtcttcagcgaggatgagatgaagaagttcctcgaggaggcaacacgcgtctctcaagaacaccccgtggtcctgactaagttcgttgagggagccagggaagtcgaaatggatgccgttggcaaggatggccgcgtgattagtcatgcaatcagcgagcatgtggaggatgctggcgtccattcgggcgacgccacgctgatgctgcccacccagacaatctcacagggagccatcgagaaagtgaaggatgcgacacgcaaaatagctaaagccttcgccatctccgggcctttcaatgttcagtttttagtgaagggaaacgatgttcttgtgatagagtgcaatctcagagccagcagatcattccccttcgtaagtaagacactgggcgtggactttatcgatgttgctactaaggttatgatcggagaaaacgtggacgagaagcatctgcccacacttgaccaccccatcattccagccgattatgttgctattaaggctcccatgttttcctggcccagactgagagatgccgatccaatcttgcgttgcgaaatggcttcgactggagaggtggcttgctttggtgagggaatccatacggcttttcttaaagcgatgctaagcacgggatttaagattcctcaaaaagggatactaataggtatccagcagagctttcggcctcgcttcctcggtgtagcagagcagctccacaatgagggtttcaaactgttcgcaaccgaggccacatctgactggttaaatgctaacaacgtgcctgcgacaccagtggcttggccgagtcaggagggccagaatccctctctctcatctatcagaaagctgataagagacggctcaattgacctcgtgataaatctacctaacaacaacaccaagtttgtgcacgacaactacgtcatcagaaggacagccgtggacagtggaattcctctgctgaccaacttccaggtgaccaagttgttcgcagaggctgtgcagaaatccaggaaggtggattccaaatcattgtttcactatcggcagtatagtgccggtaaagcggcatag

SEQ ID NO: 2409 - DNA, 213 bp, Artificial Sequence
  Description of Artificial Sequence: Synthetic coding sequence
atgacgcggattcttaccgcctttaaagtggtgagaaccctgaagaccggctttggatttacaaatgttaccgcccaccagaagtggaagttttcacggcctggtattagactgctctcagtgaaggcgcaaaccgcacacatcgtgctagaagacagggatgcagacactcctgcgccgctgctgaatcagcccgaaccccatgtgatctag

SEQ ID NO: 2410 - DNA, 606 bp, Artificial Sequence
  Description of Artificial Sequence: Synthetic coding sequence
atgagccggcgggaggggtccctggaagatccacagacggacagctctgtgagcctgttgccccacctggaggctaaaatccgccaaacccacagcctagcccacctcctcactaagtatgccgagcagcttctccaagagtacgtccagctgcagggcgatccctttgggttaccaagtttctccccaccaagattgccagtggccggtctctcagcacctgccccgagtcacgccggactgcccgtacatgagcggctgagactcgacgccgcggccctcgccgcacttccaccacttctggacgccgtgtgcaggcggcaagctgagctgaaccccagagctcctaggctgttgcgtagattggaagacgccgctcggcaggccagggctcttggcgccgcggtcgaggctctgctcgccgctctgggcgccgctaataggggtccccgtgctgagccacccgccgccaccgcatctgccgctagcgccacaggtgtgttccccgccaaggtcctggggctgcgggtatgtggcctgtacagagaatggctcagccgtaccgagggtgatctgggtcagcttctgccaggagggtcagcctag

SEQ ID NO: 2411 - DNA, 603 bp, Artificial Sequence
  Description of Artificial Sequence: Synthetic coding sequence
atgagccgaagggagggctctttggacccacagaccgacagctctgtttctcttctgcctcaccttgaggcgaagataagacagacacactctttggcccacctcctcacaaagtacgccgaacagctactgcaggaatacgttcaattgcaaggagacccgtttggtctcccgagttttagcccgcctaggcttccagttgccgggcttagcgccccagccccgagccacgccggacttccagtccacgaaagacttaggctggacgccgccgcattggccgctcttccccccctgttggacgcggtgtgccggcgccaggccgaactcaacccaagagcaccacgcttgctgagacggcttgaagacgctgctcggcaagcaagggccttgggggccgctgttgaggcactgttagccgcactgggcgcggcaaacaggggacctcgggccgagccaccagcagctactgcatccgcagcctcagctaccggagtatttccggcaaaagtccttggactccgagtgtgtgggctgtatcgcgagtggctgagcagaaccgagggtgatcttggccaattactgcccggcgggtctgcgtag

SEQ ID NO: 2412 - DNA, 513 bp, Artificial Sequence
  Description of Artificial Sequence: Synthetic coding sequence
atgaagacgcagcgggacggtcactccctggggaggtggtcacttgtgttgctcttgctaggactcgtaatgccccttgctataatcgctcaagttttgtcctataaagaggctgtacttcgggccatcgacggaataaaccaaagaagctctgacgcgaacctataccgcctgcttgacttggaccctagaccgaccatggacggggatcctgacacccctaaaccagtgagcttcaccgtgaaggagacagtatgccctcgaaccacacaacagagtcctgaagactgtgacttcaagaaggacggtctggttaagaggtgtatgggaaccgtcacactgaaccaggcccggggttccttcgatatttcttgtgataaggacaacaagcggtttgctctgctgggagatttctttcggaaaagtaaggagaagataggcaaagagtttaagaggatcgtccagcgaatcaaagactttctgcggaacctggtgccgagaactgagagttag

SEQ ID NO: 2413 - DNA, 1692 bp, Artificial Sequence
  Description of Artificial Sequence: Synthetic coding sequence
gcttgttgctgtggaggcggttgcacgtgttgcggttgcacatgcacaactggttgttgcaccacttgcacatgctgtgcttgcgcctgcacgacaggaactactaccggtgctggggcctgttgtactggtgggtgcgccgctggagggacgggctgcgggggtgcgggctgttgctgcacatgctgcgcgggagctgcaggtacagggtgcggcggcacctgcgccgctggatgcggagggtgtgccggttgcggtggggcaggagcctgcggcggctgtggagccggatgttgcgccggcggcgctgcatgttgtacctgttgctgctgctgttgtggctgcgggacctgctgctgctgcgccgggtgcacaacgtgctgttgcgccggctgtgggaccggaggatgtgggggctgtggcggcgctgcttgctgttgttgctgtggaggcgccggcgcagcagcaggggccgccacagctgctgctggagcctgtaccggcggagccacagcatgtgccggggggacttgttgcgccacaactgcctgtggcacatgcgcgacaacatgcacggggtgcgccggcggctgctgcgccgcaacaacaaccgccaccggagctggtggcgctgcaacctgttgtgctgccggcgcaaccggcgcagctactacaactgggggcgccggatgcgccggcggagccggggccggcggctgttgtggcacaacgactgggacgtgcaccgggtgtgcggggaccggatgctgttgctgtgccggcggttgtaccggatgcacatgctgctgtgccgggtgcggatgtacaacatgttgttgtgcagcatgcgccggtgctgggggggcgtgctgcgcgacatgcactggagcgactggggctactacttgcgccacagcaggggggtgtgcatgcgccgctgcttgtgcaacaggggccgctgcaacaggggcctgtactaccacaggagccgccgggacaaccacttgttgtacgacatgtgcggctactgccgcggcggccgcgtgtgcaggcgcatgcgccgccaccgcaacaggaactacagccacctgcgcaggtgctacttgcgcggccgcctgcacttgctgtggcgcatgctgctgttgcgcagcctgcggagccggtgcaaccacttgttgcacgggtgccgccggcgctgcctgtaccggatgtggtgcgggaggcgccggtgggaccggtggtggatgttgtacgtgtacaacttgtgctggctgcggagcaggatgtaccgggggcgcctgtacgggttgtacctgttgttgtactggaggagccggctgcgcatgcggcgctggcaccacatgcgctgggggagccgcaggggggtgtacttgtgctggcggagccgcaggcgctgggggcgcaggcgctgggtgtgccggatgtgcagctggctgtggcggtgctgccacagctacttgtacctgtggcgccactgggtgtgctaccgcagccactgggtgcgcgggcacaacgggcgggacagggggcggcggctgttgcgctaccggcgcttgtggcggtggtggatgctgctgtgggggtgctgcctgcacctgtgcctgttgcgctggttgcaccacagctggctgcgctggctgtggttgcacctgtggcggctgcactggatag

SEQ ID NO: 2414 - DNA, 555 bp, Artificial Sequence
  Description of Artificial Sequence: Synthetic coding sequence
atggccgaccacctgatgctggccgaaggttatcgattggtgcagagacctccatctgcggccgctgcacatggccctcacgcgctcagaaccctgccaccttatgcaggtcccggcctggatagtggcttgcgcccgaggggcgctcctctgggtcctccccccccacgccagcccggcgcgctggcctatggggcctttggaccacctagtagcttccaaccatttccagcggtgccacctcctgctgccggtatcgcccatctgcagccagtagccaccccctaccccggccgtgcagcagctcctccaaacgccccaggggggcctcctggcccacagcctgctcccagtgcagccgctcctcctccgcctgctcacgctctcggcggcatggacgccgaactcattgacgaagaggctctcacatccctcgaactcgagctgggccttcaccgagtgcgcgagctgccagagctgttccttggccagagcgagtttgattgcttcagcgatctgggatccgctccacctgccgggagcgtcagctgttag

SEQ ID NO: 2415 - DNA, 3198 bp, Artificial Sequence
  Description of Artificial Sequence: Synthetic coding sequence
atgaaaatccttatcctcggaatcttccttttcctgtgtagcacccctgcttgggctaaggagaagcactactacatcgggatcatcgagactacctgggactacgcttctgaccacggtgagaaaaaacttattagtgtggacactgaacattctaacatttacctgcagaatggaccagacagaatcgggcggctctacaagaaagcattgtatttgcagtatacagatgaaacgttcaggacaacgatcgagaagccggtttggctgggcttcctgggccctatcataaaagccgaaaccggggataaagtatacgttcatctgaagaatctggccagtagaccgtacactttccacagccacggcataacctattataaggaacatgagggggccatctatccagacaacaccactgattttcagcgcgcagacgacaaggtgtatcctggcgaacaatacacatacatgctgctggcaaccgaggaacagtctccaggggaaggagatggaaactgtgttacacggatttatcactcacacatcgacgcccctaaggatatagccagtgggcttatcggaccccttatcatatgtaagaaagattcactggataaggaaaaggagaagcatatcgacagggagtttgtcgtaatgttcagcgtggttgatgaaaatttcagctggtacctagaggataacataaagacctattgtagcgagcccgaaaaggtcgacaaagacaatgaggatttccaagaaagtaacagaatgtactctgtcaatggatacacattcgggtccctccccggactgagcatgtgcgcagaggatagggtgaaatggtacctgtttggtatgggcaacgaggtagacgtacacgccgccttttttcacggtcaggctctgaccaataagaactacagaatcgatacaatcaacctctttcctgcaacactctttgacgcctacatggtggcccagaatcctggggaatggatgctgagttgccagaatttaaaccatctcaaggccggattacaggcgttttttcaggtacaggaatgcaataaaagcagcagtaaagacaatatacgcggcaagcacgttagacactattatattgccgcggaagagatcatctggaactacgccccgtccgggattgatatttttactaaggaaaaccttacggcaccggggtccgattccgcagtattttttgagcagggcaccacccggatcggcggcagctacaagaagttagtttatagagagtatactgatgcctctttcaccaatcgtaaggagcgcggccccgaagaggaacatcttgggatactgggtcccgttatctgggcagaggtgggcgataccattcgagtaaccttccataacaagggtgcgtaccctctgtcaattgagcctattggagtaaggttcaataagaacaacgaaggcacatattattctccaaactataatcctcaatcaaggagcgtgcccccatcggctagccatgtcgcccctacagagacattcacttacgagtggacagttcccaaggaagtggggcccacaaacgccgaccccgtgtgtctggccaaaatgtactattcagcagtcgagcccaccaaagacatttttactgggctaatagggcctatgaagatctgtaagaagggatccctccatgctaacggaaggcagaaagatgtcgacaaggagttctatctgttccccactgtgtttgacgaaaatgagtcactgctcctggaagataatatccgtatgttcactactgctcccgatcaggttgacaaagaagacgaagacttccaggagtctaataagatgcactctatgaatgggttcatgtatgggaatcagccagggctgactatgtgcaaaggagattctgtcgtctggtacttatttagcgccgggaatgaagcagatgtacatggcatctacttttcggggaacacctacctctggcgcggagaaaggcgtgatactgcgaatctgttcccacagacatctcttacgttgcacatgtggcccgacacagaagggacatttaatgtggagtgtctgacgacagaccactacaccggcggcatgaaacaaaagtacactgtgaaccagtgccggagacagtcggaggactctactttttatctgggcgagagaacctactacattgctgccgtggaggtcgaatgggattattctccccagcgggagtgggaaaaggagctgcatcacctgcaagagcagaatgtgtctaacgctttcctcgacaagggggagttctatatcgggagcaaatataaaaaggtggtgtataggcagtatactgacagcacattccgtgtcccggtggaacgaaaggcggaagaggagcacctaggtattcttgggccacaactccatgctgacgtgggagacaaggtgaagattattttcaaaaacatggctacaaggccctatagtatccacgcacacggtgttcagaccgaaagctcgacagtgacacctacccttccaggtgagacactgacatacgtgtggaaaattccagagcgctccggggccggaacagaggattccgcttgcataccctgggcatactatagcaccgtggaccaggtgaaagacctatattcagggctaattggacctcttatcgtctgtcggcggccttacctgaaggtgttcaatccacggaggaaactggagttcgcgcttctgttccttgtgttcgacgagaacgaatcgtggtatctggacgataacatcaagacatacagcgaccatccagagaaagtaaacaaggacgacgaagagttcatcgaaagcaacaagatgcacgcaattaatgggcgtatgttcgggaacctccagggtctgaccatgcacgtgggcgatgaagtcaactggtaccttatgggcatggggaacgagatagacttgcataccgtgcactttcacgggcactccttccagtacaaacaccgcggcgtgtatagcagtgacgtctttgatattttcccagggacataccagactttggagatgttcccgcggacacccggaatctggcttctacactgtcatgtgaccgatcatattcacgcggggatggagaccacctacactgtgcttcagaatgaggatacaaagtcggggtag

SEQ ID NO: 2416 - DNA, 603 bp, Artificial Sequence
  Description of Artificial Sequence: Synthetic coding sequence
atggccttcaccgaacactctccacttacgcctcatcgccgtgacctctgttcacgttcgatatggctggcaaggaaaataagatccgacttaacggccctgacggaaagctatgtaaagcaccagggacttaacaaaaacattaatctggactccgccgatggcatgcccgtcgcctcgaccgatcagtggagtgagctcactgaagcagaaaggttgcaagagaatttgcaagcgtacagaacattccacgtgctgttggctcgcttgttggaggaccagcaggtgcactttacaccaacagagggggactttcaccaggccatccacactctcttgcttcaggtggccgcttttgcttatcagatcgaggaattgatgatcttgctagagtacaagattcctcggaacgaagctgacggcatgcccattaacgtgggcgatgggggactttttgaaaagaaactgtggggactcaaagtgttacaggagctgagccagtggacagttcggtccatccacgatctgcggttcatatcatcacatcaaaccggcattcccgcccggggcagccattatattgctaataacaagaaaatgtag

SEQ ID NO: 2417 - DNA, 1869 bp, Artificial Sequence
  Description of Artificial Sequence: Synthetic coding sequence
atggctcatgtgagaggactacagcttcccgggtgtttagccctggcagccctttgcagcttagtccattcacagcatgtgttcctcgccccacagcaagcccgatctctgctgcagagagttcggcgagcaaacaccttcctcgaagaggtaaggaagggtaatctggagcgggaatgcgtggaggaaacatgctcctacgaggaggcctttgaggctctggaaagtagtacagccaccgacgttttttgggctaagtacacagcctgcgagaccgcccggaccccaagggataaactggcagcttgtctcgaaggtaactgtgccgagggattggggacgaattatagaggccatgttaacatcacccgcagcgggattgaatgccagctatggcgctctaggtatccccacaagcctgagatcaacagtaccacccatccgggcgccgatctgcaggagaacttctgtagaaaccctgatagctctactaccggtccatggtgctacaccacagaccccactgtaagacggcaggaatgttccatccctgtttgtggacaggaccaggtgactgtcgcaatgacccctaggtctgagggatccagcgtgaatttgtcccctcccttagagcagtgcgtcccggaccgaggccagcagtaccagggacgactcgcagttacaactcacggactgccctgcttggcatgggccagtgcacaggccaaggctctgagcaaacaccaggactttaacagtgcagttcagctggtggagaacttttgtaggaacccggacggagatgaagaaggagtttggtgctatgtagcgggaaaaccaggtgattttgggtactgcgacctgaattactgcgaggaagcagtggaggaggaaaccggggacgggctggatgaggactccgaccgggccatcgagggaaggacagctacctcagaatatcaaaccttcttcaaccctcggaccttcggctccggggaggcagactgtggacttcgccccctctttgagaagaaatccctagaggataaaaccgaacgcgagctgctcgagagctatatagatggcagaattgtggaagggtcggacgccgaaattggcatgtccccctggcaggtcatgctgttccgaaagtccccccaggagttgttgtgtggcgccagcctgatttctgatcggtgggtgcttacagccgcacactgtttattatatccaccatgggataagaacttcaccgagaacgacttgctggtccgcatcggcaaacacagccgcactaggtacgaacgtaatatagaaaagattagtatgctggagaaaatatatattcacccaaggtataactggcgcgaaaatctggatcgggatattgcactaatgaaactcaaaaaacccgtagcatttagcgattacattcatccagtctgtttacctgatagggagactgcagcgtcgctgttacaggccggatacaaggggagagtcacgggatggggcaacctgaaagaaacttggacggccaacgtgggaaagggccaaccctctgttctacaggtcgtgaatctgccgatcgtagaaagacccgtgtgcaaagattctacacggatacgaatcactgacaacatgttctgtgcagggtataagcccgacgaaggcaaaaggggtgacgcttgtgaaggagactctgggggacccttcgtgatgaagagcccattcaacaataggtggtatcaaatgggtatagtaagctggggggagggctgcgacagagatggaaaatacgggttctatactcatgtctttagattaaagaagtggatacagaaggttatcgaccaatttggggagtag

SEQ ID NO: 2418 - DNA, 195 bp, Artificial Sequence
  Description of Artificial Sequence: Synthetic coding sequence
ttgcagggagaattcctgccccaaccaaggcagcaacatcacggtactttggtcctgcactacagaccccaccgtgaagaggccggcatgcagcatccatgtttatggccaggctcctcccattgttccgacgattccaccttgcgaagactacagtgcgagagcgtgacctctatcggcgccgtgtgcccctag

SEQ ID NO: 2419 - DNA, 1752 bp, Artificial Sequence
  Description of Artificial Sequence: Synthetic coding sequence
atggcccatgtaaggggactgcagctgcccggctgcctggccctggcggccctctgtagcttggtacacagccaacacgtgttccttgctcctcaacaggccaggagtttactgcagagagtgcgaagggccaatacttttctcgaggaagtgcggaaaggaaacctggaaagggagtgcgttgaggaaacttgctcctacgaggaagccttcgaggccttggagagtagcacagctacagatgtattctgggctaagtatacggcctgtgagaccgctcggactcctagagataagctcgccgcttgtctggaggggaattgcgccgagggcttgggcacaaactaccgtggccatgtgaacatcactaggagcggaatcgaatgccagctgtggcgcagtcgctacccacacaagcccgaaatcaattccacaacccatccgggggcagatctccaagaaaacttctgcaggaaccctgactcctctactacaggcccttggtgttatacaacagaccctaccgtgcgacgtcaggaatgcagcattcctgtgtgtggccaggatcaagtgactgtggccatgacaccaaggtctgaagggtcttccgtgaatctaagtccccccctggaacagtgcgtccccgacaggggccagcagtaccagggtcgcttagccgttactacgcacggactgccttgtctcgcgtgggcatcagcgcaggcaaaggccctgtcaaaacaccaagactttaactcagccgtgcaactggtggaaaacttctgcagaaatccagacggcgatgaagaaggcgtgtggtgctacgtggccggaaagcctggagacttcggctactgcgacttaaactattgtgaggaggccgttgaagaagagacgggtgatggcctcgacgaggacagtgatcgggccatcgaaggccgtaccgccacctctgagtaccagacattcttcaatcctaggactttcggctctggggaagccgactgtggactgcggcctctctttgaaaaaaaaagccttgaagataaaacggaacgcgaactgctggaatcatacattgacggcagaatcgtggaggggagcgatgctgagattggcatgtccccgtggcaggtgatgcttttcagaaaaagtccccaggagctattatgcggcgcaagcctcatttctgaccgatgggtgctgacggctgcccattgtctactgtaccctccctgggataaaaattttacagagaatgatctgctggtacgcatcggaaaacattctagaacccggtatgagcgtaatatcgaaaaaatttccatgttggagaagatctatattcatccatccctcctgcaggctggatacaaggggcgcgtgacaggctgggggaatctgaaggaaacttggacagccaatgttggcaagggccagcccagtgtcttgcaggtggtcaatctccctattgtggagcgtcccgtttgcaaggactctactcgaattcgcatcacggataatatgttctgtgctggctacaaacccgatgaaggtaagcggggggatgcatgcgagggagactccggaggaccattcgtcatgaagtccccgtttaataaccgctggtaccagatggggatcgttagctggggcgaggggtgtgaccgagacggcaaatatggcttttacacgcatgtgtttaggctcaagaaatggatccagaaagtcatcgatcagttcggggagtag

SEQ ID NO: 2420 - DNA, 888 bp, Artificial Sequence
  Description of Artificial Sequence: Synthetic coding sequence
atggagacacccgcctggccaagagttccacgtcctgagacagctgtggcccggactctgctcctgggctgggtgtttgcccaagtcgctggtgcttctggcaccacgaataccgtggccgcctataatttaacgtggaaaagcacgaatttcaagaccatactggaatgggagcctaaaccagtcaatcaggtgtatacagttcagattagcaccaaaagcggagactggaagtcaaagtgtttctacaccactgatactgaatgcgatcttaccgacgagattgtcaaggacgtgaaacagacatatctggcgagagtgtttagttatcccgctggtaatgtcgagagcacgggtagtgcaggggaaccactgtatgagaatagtcccgaattcaccccatacttggagaccaatctgggtcagccaaccatacagtcgtttgagcaggtaggcacaaaggtgaatgtgaccgtggaggatgaaagaacactggtacgacgcaacaataccttcctgtctctgcgagacgtgtttgggaaagacttgatctacacactttactattggaagtctagtagttccgggaaaaaaaccgccaagaccaatacaaatgagttcctgatcgacgttgataaaggcgaaaattattgtttctcagttcaagctgtgatccccagcaggaccgtcaatcggaagtctactgatagtccagtggagtgcatgggccaggaaaagggagaattccgcgaaattttctacatcatcggagccgtcgtgtttgtagtgatcatcctcgtgataatccttgctattagtctgcataagtgcaggaaagccggagtcggtcaaagctggaaggagaactctcctctaaacgtttcatag

SEQ ID NO: 2421 - DNA, 717 bp, Artificial Sequence
  Description of Artificial Sequence: Synthetic coding sequence
atggagacacccgcatggccgagagttcccagacccgagactgctgtggccaggaccctgctcctcgggtgggtgttcgctcaggtggctggagcctcgggaactaccaacaccgtggctgcctataacctgacttggaaatcaactaacttcaagactatccttgaatgggaacccaagccagtaaaccaggtgtatacagtccagatctccaccaagagcggggattggaaatctaagtgcttctacacaactgacaccgaatgtgacttgacagacgagattgtgaaggacgtgaaacaaacctatctggcccgtgtgttctcttaccccgccggcaatgtggagagtacaggctccgcaggcgaacccttgtacgaaaattccccagagtttacaccctacctggaaaccaatctgggtcagccgacaatccagtcatttgagcaggttggaacaaaggtgaatgttaccgtagaggatgaacggacattggttagacgcaacaatacatttcttagtcttagggatgtatttgggaaagatctgatctacactctgtattactggaaatcaagctcaagcgggaaaaaatattcaacttcgttagaactgtggtacctgtggtccagtagtctgagctccagctggctgtatctgtacacatccgtggagagacaggaatgggggagagctgggcgcaggactccacactag

SEQ ID NO: 2422 - DNA, 3807 bp, Artificial Sequence
  Description of Artificial Sequence: Synthetic coding sequence
atgatcgcagcaccagagatccccaccgatttcaacctccttcaggaatccgaaacccacttcagtagtgacaccgacttcgaagacatagaagggaagaatcagaagcaaggcaaaggaaagacctgcaaaaaggggaaaaaaggcccagcggagaaaggcaagggtggcaatggtggtggcaaacctcctagcggccccaaccggatgaatggccatcaccagcagaatggagtcgagaatatgatgctattcgaggtagtaaaaatgggtaagtcagccatgcagtcagtagtggacgactggatcgagtcttacaagcacgatcgtgacatcgcacttctggatttaattaacttcttcatacagtgcagcgggtgtaagggcgtagtgactgccgagatgttcaggcatatgcagaacagcgagataattcgcaaaatgactgaggagttcgacgaagatagcggggattaccccctcacaatggcaggtcctcagtggaaaaagttcaaaagttcattttgcgagtttattggcgtgttggtgaggcaatgccagtacagtattatatacgacgagtatatgatggatactgttatcagtctcctgacgggcttgtccgattcacaagtaagagcattccgccatactagcactcttgcagctatgaagctcatgacagctctggtgaacgtcgctttaaatctcagcatcaacatggataacacacagaggcagtacgaggcagaacggaataaaatgatcgggaagcgcgccaacgaacggcttgaattgctgctgcaaaagcgaaaagaattgcaagaaaatcaggatgagattgaaaatatgatgaacgccatttttaagggagtgtttgtccaccggtatagagatgctattgctgagattcgcgctatttgtattgaggagatcgggatctggatgaaaatgtactccgacgcatttctcaacgattcctacttgaagtatgtggggtggactatgcatgataagcagggggaagttcggctgaaatgtttgaccgccctgcagggactttattacaacaaagagcttaattccaagctggagcttttcacatccagattcaaagatcgtattgtgtctatgactctggataaagaatacgacgtggccgttcaggctattaagctcttgacactggtgctccagagctccgaagaggtgctgaccgccgaagattgcgagaatgtgtaccatctagtatacagtgcacaccgccctgtcgccgtcgctgcaggagagttcctgtacaagaagctgttcagtcgccgggatcctgaggaagacggtatgatgaagaggagaggccggcaggggccgaacgccaacctagtgaagaccctcgtctttttcttcctggaatctgaactgcatgaacacgcggcatatctggttgactcaatgtgggactgtgcaacggagttgctcaaggactgggaatgcatgaactcacttctcctggaggaacccctgtcaggcgaggaagcactgacggaccgtcaggaaagtgctcttatagagataatgctgtgtaccatccggcaggccgccgagtgtcacccccccgtaggaaggggtaccggaaaaagagtactgacagccaaagagaaaaaaactcagcttgatgacagaacaaagataacagagctatttgctgtggctctgcctcagctgctggccaaatacagtgtggatgccgaaaaggtgaccaatctgctgcagctcccccaatatttcgatctggaaatttataccacagggaggcttgagaagcatcttgacgccctcctgagacaaattcgcaatatcgtcgagaaacacactgacacagacgtcctagaagcatgcagcaagacttaccacgccctgtgcaatgaggagttcacaatttttaatagggttgatatctcccgcagccagctcattgacgagctggccgataagtttaaccggctgctcgaggactttctgcaggaaggcgaggagcccgatgaagacgacgcctaccaggtgctgtccacactgaaacgtatcactgcttttcacaacgcccacgacttgtctaagtgggacttatttgcttgtaattataagcttcttaaaaccgggattgaaaatggagacatgcccgagcagattgtgatccatgcactgcagtgtacccactacgttatcttatggcaactggccaagattacggagtcatccagcacaaaagaggatttgctgagactgaagaagcaaatgcgggtgttttgccagatatgccagcattacctcactaatgtaaataccactgtgaaagagcaagccttcaccatcctctgcgacattctgatgattttcagtcaccagataatgtctggaggccgagatatgttagagcctttggtgtatacccccgattccagcctgcagagcgagctgctgtcatttattctggatcatgtttttattgagcaggacgatgataacaactccgccgatgggcaacaagaggacgaagcatcgaagattgaagcactgcataaacgccggaacctgctggcagccttctgcaaactgatagtttataccgtggtggaaatgaataccgccgccgacattttcaagcagtatatgaagtattataatgattacggcgatatcatcaaagagaccatgtcaaagactaggcaaatagataagatccagtgcgcaaaaacactgattctgtccctccagcagctctttaatgaaatgattcaggagaacgggtacaactttgaccggtcctcaagcaccttcagtgggataaaagaactggcgagaaggttcgcccttacatttggcctggaccagctgaaaacaagagaggccatcgctatgctgcataaggatggtatcgagtttgccttcaaggagccaaacccacagggagaatctcaccctccactcaacctggccttcctggacatcctgtccgaatttagttcaaaattgctgagacaagacaagagaacggtgtacgtgtacctagagaaattcatgactttccagatgagcctgcggagggaagatgtttggctccctttgatgtcttaccggaatagcttactcgctggaggggatgacgacactatgtccgtcatcagcggtatatcttcacgcggcagcaccgtcaggagcaagaagagtaaacccagcaccggaaagaggaaggtagttgagggcatgcagctgagtcttactgaagaatcatcatcgtctgactccatgtggctgagtcgcgaacagacgctccatacacctgttatgatgcagacgccacagcttacaagtacaatcatgcgagagcctaaacgattaagacctgaagattcattcatgagcgtgtacccaatgcagaccgagcatcaccagacacctctcgattataatacccaggtgacctggatgttagctcagaggcagcaagaagaagcccgtcaacagcaagagagggcagccatgtcctatgtcaagctcaggactaatctgcaacacgccatcagaagaggcacctccctgatggaggatgatgaagagcctattgtggaagatgtgatgatgagtagtgaagggcgtattgaggatttgaacgagggaatggacttcgacaccatggacattgatcttccaccgagtaaaaatagaagagagagaaccgaactgaaaccggacttttttgaccccgcttctatcatggatgaaagtgtcctgggagtgtccatgttttag

SEQ ID NO: 2423 - DNA, 1272 bp, Artificial Sequence
  Description of Artificial Sequence: Synthetic coding sequence
atgcaaagggtgaacatgatcatggccgagtcgcctgggctcatcaccatatgcctcttaggatacctgttgagcgccgaatgcaccgtgttcctcgaccacgagaatgcaaacaaaattctaaacaggcctaaaagatacaactctgggaaactggaggagtttgtgcaaggaaatttagagcgcgaatgcatggaggaaaagtgttctttcgaggaagccagggaagtgtttgaaaacacggaacgcacaaccgaattctggaagcagtatgtcgatgtcacttgcaatataaaaaatgggcgttgcgagcagttctgcaaaaactccgcggacaacaaggtcgtctgctcctgtacagagggttacagactggccgaaaaccagaagtcgtgtgagccagctgtgccctttccctgtgggagagtgagtgtttctcagacttctaaactcactagagcagaaacagttttccctgatgtagattatgtaaactcgacagaggccgagaccatcctggacaacataacacaaagcacacagagttttaacgattttacgcgcgtagtggggggcgaggatgccaagccgggacagtttccatggcaggtggtcctcaatggcaaagtggacgccttttgcggcggctcaatcgtaaacgaaaagtggatcgtgactgctgctcactgtgttgagaccggggtgaagatcacagtcgtagcgggggagcacaatatcgaggagaccgagcacacagagcagaagcgcaatgttatacgaatcattccccaccacaattataatgcggcaattaacaagtataaccacgacatcgccctgctggagctcgatgagcctctggtgctgaattcctacgttacgcccatctgcatagcggataaagagtatacaaacattttcttgaagtttggttccggatacgtatccggatgggggcgcgtgttccacaagggccgctctgccctggtgctgcagtacttgcgggtgcccttagtcgaccgcgccacctgcttgcgctcaacgaagttcacaatctataataacatgttctgtgcgggctttcacgagggcgggagagactcatgccagggtgactctggcgggccacacgtgacagaggtggagggtacctcattcctgactgggataatctcctggggtgaggaatgtgctatgaaaggtaagtacggcatctatacaaaggtatctcggtatgtcaactggattaaggaaaaaacaaagctaacctag

SEQ ID NO: 2424 - DNA, 6690 bp, Artificial Sequence
  Description of Artificial Sequence: Synthetic coding sequence
atgttccctggttgccctcgcctctgggtactggtcgtactagggacttcctgggtggggtggggaagccagggaacggaagcagcacagctgaggcagttctacgtggctgcccagggcatcagttggtcctacagaccagaaccaactaacagttcattgaatctgtccgtcacatcttttaaaaaaatcgtgtatcgggaatatgaaccttatttcaaaaaggagaagccccaatccactatatcaggactcttggggcccactctttacgccgaggtgggggatatcattaaagtccacttcaagaataaggctgacaaacctctaagtatacaccctcaggggatccggtattctaagctgtcagagggcgccagctatttggaccatacctttcccgccgagaaaatggatgatgctgtcgctcccggtagagaatatacttacgagtggtcgatctcagaggacagcgggcccactcatgacgatcccccctgtctgacacacatctactacagccacgagaatcttattgaggactttaatagcggtctgatcggcccattactgatttgcaagaaggggactctcacagagggaggaacacagaagacatttgacaaacagatcgtgttgctcttcgccgtttttgacgaaagtaagagctggagccagagttcttctttgatgtacactgtgaacggatacgtgaacgggacaatgcctgatatcacagtctgtgctcatgatcatattagctggcacttactgggtatgagttctggtcccgaattgttttctatccattttaacggacaggttctggaacagaaccaccataaggtgtccgcaatcacgctggttagtgccacgtctaccacagctaatatgactgtaggccccgagggcaagtggattatatcttctcttacccctaagcacctccaagccggcatgcaggcttacattgatatcaagaactgtcctaagaagaccaggaaccttaagaagatcacacgagagcagagacggcacatgaaacgatgggaatattttattgcggcagaggaagtgatttgggactacgctcccgttatccctgcaaacatggataagaaatatcggtctcagcacctcgataactttagcaaccaaataggaaagcattacaagaaagtcatgtacacccagtatgaagacgagtcttttacgaagcataccgtgaacccaaatatgaaggaggatggaatccttggaccaattatccgtgctcaggtccgagatacccttaaaatcgtcttcaaaaatatggctagtagaccttattcaatatatccccatggagtcacgttttccccatatgaggatgaagtgaactcttcattcacctctgggcgaaacaacacaatgatcagggctgtacaacccggcgagacttacacttacaagtggaacatcctagaatttgatgaacccaccgagaacgatgcacagtgcctcaccaggccttactattctgacgtggacatcatgcgggatattgccagtggcttaattggcctgttactcatctgtaagagtagaagtttggaccgtcaggggattcaacgagcagcagatatcgagcagcaagcagtgtttgctgttttcgatgaaaataaaagctggtatctggaggataatattaacaaattttgcgagaatccagacgaggtcaaacgagatgaccccaagttttacgaatccaatataatgagcaactttactctgtctgccatcaacggctatgtacccgaatcgattaccactctaggattctgcttcgacgacaccgtacaatggcatttctgctcagtaggaacccagaacgaaatccttacaatacacttcaccggccacagcttcatctacgggaagcgacatgaggatacattgacactgttcccgatgcggggcgagagcgtgacggttaccatggacaacgtgggaacctggatgttaactagcatgaactcatcaccacgttctaagaaattgcgactgaaatttcgagacgtcaaatgcatcccagatgacgacgaagatagttacgagatcttcgagcctcctgaatctacggtcatggcgacaaggaagatgcatgataggctggagcctgaggatgaagagtccgatgccgactacgattatcagaacaggctcgctgccgccctgggaattcggtcctttaggaattcgtccctgaatcaggaagaggaggaatttaacctcacagctctggcactcgagaatgggaccgagtttgtctccagcaatacagatattattgttgggtctaattattccagcccaagtaacatttcaaagttcactgttaacaatctcgccgaacctcagaaagcgcctagccaccagcaggcaaccacggccggctctcccctgaggcatctgataggtaagaattccgttctaaactcttccacagcagaacattccagtccttacagtgaggatccgattgaggacccacttcaacctgacgtgaccgggatccgcttgctgtccttgggagcaggtgagttcaagtcacaggagcacgcaaagcacaaaggtcctaaggtagagagagatcaagccgcaaaacaccgttttagttggatgaaattgctcgctcacaaagtcggccgacacctgagtcaggataccggatcaccaagtggaatgcggccctgggaagacctgccctctcaggatactggttcccctagtaggatgcggccttggaaggacccgccctctgatctactcctgctgaagcaatccaacagcagcaagatattggtgggccgctggcacctggccagcgaaaagggtagctacgagattatccaggataccgacgaggacaccgccgtcaacaactggctcatcagcccccagaatgccagtcgggcctggggtgagtcaacccccctcgctaacaaacccgggaagcaaagtggacaccccaaattcccacgagttcgccacaagagtcttcaagtgcgccaggatggcggcaagtcccgcctcaagaagtcccagttccttatcaagacacggaagaagaaaaaagagaagcacacccatcacgcccctctgagtcctcgaacgtttcatcctctgcggtccgaggcatacaacacctttagcgagcgacgactgaagcactccctggtattgcataaaagcaatgagacaagtctacctaccgatttgaaccagacccttccctcgatggatttcggatggatagcctctctacctgatcataaccagaatagtagcaatgacaccgggcaggcaagttgccctcctggattgtaccagaccgttccacccgaagagcactatcagacatttcccatccaggaccctgatcagatgcattcaaccagcgacccaagccataggtcctccagtccggaactctcagagatgctcgagtacgatcggtcccataagagtttcccaaccgatatttcgcagatgagcccgtcatctgaacacgaggtgtggcaaaccgtgatcagccccgatctctctcaagtgactctgtcccctgagctctcgcagaccaacctgtccccagacctgagccatacaacgctgtccccagagctaatccagcggaacctgtctccagccctgggacagatgcctataagccccgaccttagtcatacaacactgtcgccagacctgagccatacaaccctgtctttggacttgtcacagacgaaccttagccctgagctgtcacagaccaacctgagcccagctctggggcaaatgccattgtcacctgatctttcccatactactctgagcctcgacttttcccagaccaacctctcccccgaactatctcatatgaccctgagccccgagctctcccaaactaacttatcacctgcattgggtcaaatgccaatatcccccgatctctctcataccacactctcgctggacttctcccaaactaatctgtctcccgagcttagtcagaccaatctgtctcctgcactcggccaaatgcccctgtctcccgatccatctcatactaccttgtctctggacctgtctcaaactaatttgagtcctgaactttcccagacaaatctgtcgcccgacctgtctgagatgccactgttcgccgatcttagccaaattccactaactccagacctagaccaaatgacattgagtccagaccttggggagaccgatctgtcgcctaactttggtcagatgtccctctcccctgacctttctcaggttacactgtcgcctgacattagcgacaccactctactgcccgatctgagccagatatccccgcctcctgatctggaccagatcttctatccatcggagtccagccagagtttgcttctacaggagttcaatgagagtttcccgtacccagacttagggcagatgccctcccccagctcacccaccctgaatgatacatttttgagcaaggagttcaatccacttgtgattgtaggactgagcaaagatggcacagactatatcgagatcattccaaaggaggaggtgcagagctctgaggacgactatgccgaaatcgactatgttccatatgacgatccgtacaaaactgacgtgagaaccaacataaatagctccagagatcccgacaacatcgctgcctggtacctgcgctctaataacgggaacagacggaactactacatcgcagccgaagaaatttcctgggattactcagagttcgtgcagagggagacagatatagaggacagtgatgatatacccgaggataccacctacaaaaaagttgtttttcgcaaatatctggatagcaccttcactaagagagatccacgcggcgagtacgaggaacatctggggattctcggtccaattatacgagccgaggtggacgatgtgattcaggtcaggttcaagaacttagcctctagaccctactccctgcatgcccatggtttgtcctatgaaaagtcctccgagggcaaaacttatgaggacgactcccccgagtggttcaaggaggataatgctgtgcagcccaactctagttacacttatgtgtggcacgctaccgagcggagtggccccgaatcccctggatcggcctgtcgcgcctgggcatattatagcgctgttaaccctgagaaggacatccacagcggactaatcgggcccctgcttatctgccagaagggcattctccataaggacagcaatatgccaatggacatgagggagtttgtcctcctgttcatgacttttgatgaaaagaagtcttggtactacgagaaaaagtcaaggagttcctggcgcctcacgtcatcagagatgaagaagtcccacgaattccacgccatcaatggcatgatttactcattacccggcctcaaaatgtacgaacaggaatgggtccggctacatctgctgaatatcggggggtcacaggatatccacgttgtgcatttccatgggcagacactcttagaaaacggaaacaaacagcatcagttaggggtgtggcctctgctgccaggatcattcaagacactggagatgaaagcctccaaaccaggctggtggctgctcaataccgaggttggtgaaaatcagagggcgggaatgcagactccattcctgatcatggatagggactgccgtatgcctatgggactaagcacgggtattatatccgattcgcagatcaaagcgtcagagtttttaggatattgggaaccccgactggcaagactgaataatggagggtcctacaacgcatggtcggtggagaagcttgctgctgagtttgcgagcaagccatggatccaagtcgacatgcagaaggaagtgattattacaggcatccaaacccaaggagccaagcattaccttaagagctgttacacaacagaattttacgtggcctattctagcaaccagatcaattggcagatcttcaaggggaacagtacacgaaatgttatgtattttaatggaaacagcgacgcaagcacaatcaaggaaaaccaattcgacccacctatagtcgctcgctatatacgaatctcaccaaccagggcctataaccggcctaccctcagactagagctgcagggctgtgaagtgaatgggtgttctacccctttaggtatggagaatgggaagattgaaaacaagcaaatcacagcctcctcctttaagaagagttggtggggcgattattgggaaccattccgggctaggctgaatgcacaaggacgagttaacgcgtggcaggccaaagcgaataataacaaacagtggttggagatcgacctgctcaaaattaagaagattacagctatcattacccaaggatgcaagtctctttcttctgagatgtatgtgaaatcatacaccatccactattcagaacagggagttgagtggaaaccgtatcgcctaaaatcctccatggtcgataaaatattcgagggtaatactaatacaaaaggccacgtgaagaacttttttaatccacccatcatcagccggtttattagggtcatccccaaaacttggaaccagtcgatagctctgaggcttgaacttttcggctgtgacatatattag

SEQ ID NO: 2425 - DNA, 6675 bp, Artificial Sequence
  Description of Artificial Sequence: Synthetic coding sequence
atgtttcccgggtgcccgcgtttatgggtgctggtggtcttggggaccagctgggtgggctggggcagtcaagggaccgaggctgcgcagctgcgtcagttttacgtggctgctcagggtatatcatggagttatcgccccgagccaacaaacagtagcctgaacctgtctgttacatcgttcaagaaaatagtctatcgtgaatacgaaccctactttaagaaggaaaaaccacagtctacgattagtgggctgttaggccccacgctgtacgctgaggtaggagacataatcaaagtacatttcaaaaacaaggccgacaagccactttcgatccatccgcagggaatcagatattcaaaactgtctgagggagcatcttacctcgaccacacattccctgccgaaaaaatggatgacgcagtggcccccgggagagagtacacatacgagtggagcatatcggaggatagtggtccaacgcatgacgatcctccttgtcttacacacatatactattcccatgagaatctaattgaagatttcaatagcggcctgatcgggcccctgcttatttgtaaaaaaggcacgcttacagagggagggacccaaaagacctttgacaaacaaattgtgctcctcttcgcagtctttgacgagtcaaagtcctggagccaatctagctctctaatgtacaccgttaatgggtatgtgaatggcaccatgcccgatatcacagtttgtgcccacgatcacataagttggcatctgctgggtatgtcttctggacccgaattgttctctattcacttcaacggacaggtgttggagcaaaaccaccataaggtaagcgctataacactcgtcagtgcaacttcaaccacggcaaacatgaccgtcgggcccgagggcaaatggatcatttcaagcctgacccctaagcacctgcaagcgggcatgcaagcctatatcgacatcaaaaactgcccaaagaagactcgaaatttaaaaaagattacacgcgaacagagacggcacatgaagcggtgggagtactttattgcagccgaagaggtgatctgggactacgcaccagtgatccccgccaacatggataagaagtacagatcccagcatcttgacaatttttcgaaccagatcggcaagcattataaaaaggtcatgtacacccagtacgaagatgagagtttcactaagcacacggtaaacccaaatatgaaggaggatgggatcctgggacccattataagggctcaggtgcgggatacactcaaaatcgtttttaagaacatggctagtagaccctactcaatctacccgcatggcgtgactttcagtccatacgaagatgaggtgaatagctcgtttaccagtggacgtaacaatacaatgattagagccgtccagccgggcgagacctatacgtataaatggaatatcctcgaatttgatgagccaaccgaaaatgatgctcaatgcttgacccgcccctactacagtgacgtggatatcatgcgcgatattgccagcgggttaattggactcttactgatctgcaaaagccggagcctagatcgccagggcattcagagggccgcggatatcgagcagcaggcagtatttgccgtgttcgatgaaaataagagttggtaccttgaagacaatatcaacaagttttgcgagaatcctgatgaagtgaagcgggatgatcccaaattctacgaatcaaacattatgtccacaataaacgggtacgtgcccgagtcgattacaaccctgggattttgcttcgatgacacagtccagtggcatttctgtagcgtggggacgcagaacgaaatcttaaccatacactttaccggccacagcttcatttacggcaagcggcacgaggacactctcactttgttccctatgcgcggagagtcggtgaccgttacaatggataatgtggggacttggatgcttacctctatgaactccagcccacgctccaaaaaacttcggctgaagttccgcgacgtgaaatgcatccccgatgatgacgaagactcctatgagattttcgagcctccggaatccactgtaatggctacccgcaagatgcacgatcgtcttgaacctgaggacgaagagagcgacgccgactacgactaccaaaatcgcctggccgccgccctgggcattaggagtttcagaaattctagcctaaatcaggaagaggaagaattcaacctgactgccctggccctggagaatggaacagaattcgttagctctaatactgatatcatcgtggggtctaactattcatctccctcaaacatttccaagttcaccgtaaacaatctggccgaaccccagaaagccccatctcatcaacaagctactaccgctggatctcctctgaggcacctaatagggaagaacagcgttctgaattcaagcactgcagaacactcttctccctatagcgaagaccccatcgaagatcccctgcagcctgatgtaactgggattcgcctgctcagcctgggtgccggagaatttaagtctcaggagcatgctaaacacaagggccccaaagtggagagggaccaggcagccaaacatagattttcttggatgaaattgttggctcacaaggtcggccgccacctcagccaggacacaggctctccttcaggaatgagaccatgggaagatctcccttcgcaggacacagggtctcctagccgtatgcgaccctggaaggacccgccgtccgatctgctactgctaaaacaaagcaattcttctaagattctggttggaagatggcatctggcctcggagaaggggtcttacgagatcatccaggacactgatgaagacaccgctgttaataactggctaatctcgcctcagaatgcaagtcgtgcctggggcgagagcactcccctggctaacaagcccggcaagcagagtggtcatcccaagttcccgagagttagacataaaagccttcaagtaaggcaggacgggggtaaatcacgccttaaaaagtcccaattcctcataaagacacgtaaaaaaaaaaaggaaaaacatacccatcatgcccctctgagcccgaggacctttcacccgctcagatccgaggcttacaatactttttcagagagaaggcttaagcactctctggttctgcataagagtaatgagacctccctgccgactgatctcaaccagactctgccatctatggacttcggctggatcgcctcactcccggaccacaatcagaattctagtaatgataccggacaggcgtcctgtccccccgggctgtaccaaaccgtcccacccgaggaacattatcagacctttcctatacaggaccctgaccagatgcacagcacatccgaccccagccaccgttcttccagtcccgaactttcggaaatgttagagtacgaccgctcccataagtcttttcccacagatatttcacagatgagcccgagctccgaacacgaggtgtggcagactgttattagccctgacttgtctcaagtgactctgagccccgagcttagtcagaccaacctctctcctgatctgtcacacacaactctgtctcccgagctcattcagcggaatctgtcgcctgccctaggtcaaatgcctatcagcccagacctgtctcatactacactttcccccgacctgtcacacactacactctcattagacttgtcccaaactaacttgtccccagagctctcgcagactaatctctcaccagcgctggggcaaatgcccctctcacccgacttgtcccatacaacgttatctctggacttcagccagacaaatctgagtccagaattgagccacatgacattaagccctgagctctctcagactaatctgtctccagcactgggacagatgccaatcagtcctgatctgtcccatacaactctatcactcgacttttctcagacaaacctgtctcccgagcttagccagaccaatctcagccctgctttaggtcagatgccattatcaccggatccttctcacactactctgagtctggatctatcgcagaccaatcttagtcctgagttgagccagacaaacctcagcccagatttaagtgagatgccgctgttcgccgatctgagccagatcccattaaccccagacttagaccagatgactctcagccctgacctgggagaaaccgacctgagccctaacttcggccagatgagcctgagtccagatctatctcaggttactctgtctcctgatatctcagacacaacactactacctgacctgtctcagatttccccccctcccgacctggaccaaattttctacccatcagagtcttctcagtccctgctcctgcaggaatttaacgagagtttcccctatcctgatctgggacagatgccttcacctagctctccaaccctgaatgataccttcctttctaaggagtttaacccgctcgtaatcgtggggttgagtaaagatggcacggattatatcgaaataatacccaaggaggaggtccagagttcagaggatgattacgcggaaatagactatgtcccatatgacgatccctacaaaacggatgtacgaaccaatataaatagcagtagggatccggataatatcgcggcctggtatctccgttctaacaacggtaatcggcgaaattattacatagctgctgaggagatatcttgggattattctgaattcgtccagagggagaccgatattgaagatagcgacgatattcccgaggacacaacttacaagaaggtggttttcagaaagtacctggactcaactttcaccaagcgggatccacgtggggaatatgaggagcatttaggcatacttggacccatcattagggcagaggtggatgatgtgattcaggttcggttcaaaaatctagcttcacgcccgtatagccttcatgcccatggattatcgtatgaaaaatctagcgagggaaagacttatgaagacgactcccctgagtggttcaaagaagacaacgcagtgcaacccaacagcagctatacctacgtgtggcacgctaccgagcgctctggccccgagtcgcccgggagcgcgtgtcgcgcctgggcctactattctgcagttaatccggagaaagatattcacagtggcttgatcgggccactactgatttgccagaaaggaatcctgcataaagatagtaacatgccgatggacatgagggagtttgttctgctgttcatgacgtttgacgaaaagaaatcctggtactacgagaaaaagtccagatcaagctggcggctcacttcctctgagatgaaaaaaagccatgaattccatgccataaacggtatgatctactcgctgcctgggctaaaaatgtatgaacaggagtgggtgagactgcacctcttaaacatcggagggtctcaggacattcacgtcgtacatttccatggccagacactgctggagaatggaaacaagcagcatcagctgggcgtgtggccactgctaccaggaagtttcaagactttggagatgaaggccagtaagcccggctggtggctgctcaatacggaggtgggtgagaatcagagagcaggcatgcagaccccatttcttatcatggatcgcgactgtcgcatgccaatggggctgtccaccggtattatttcagacagtcagattaaggcatctgaattcctcggctattgggaacctcggctagcccgtcttaacaatgggggctcctataatgcttggtcagtggaaaagctggcagcggagtttgcctcaaagccatggatccaggtggatatgcagaaggaggtcattataaccggcattcagactcaaggcgcaaagcattacctgaagtcctgctacacgacagaattttacgtcgcttattctagcaaccagattaattggcagatttttaaaggtaattctacgcggaatgtcatgtattttaatgggaactcagacgcctctacgataaaagagaatcagtttgacccaccaatcgttgcccggtacatccggatcagtccaacccgcgcctacaaccgccctacgctgcgcttagagctccaaggttgtgaggtgaacggatgctctacaccgctgggtatggagaacggtaagattgaaaataagcaaattacagcttcgtcattcaagaagtcttggtggggggactactgggaaccttttcgggctagactaaacgcccaaggcagagtaaacgcctggcaggctaaggcgaataataacaaacagtggcttgaaatcgacctgctgaagatcaagaagattacagccataatcacacagggttgtaagtccttgagcagtgagatgtacgtgaagagttacaccattcattactcagaacagggcgtggagtggaaaccttataggctgaaatctagtatggtggataaaatctttgagggcaataccaacaccaagggtcatgtgaagaatttcttcaatccccctataatctcacgattcattcgcgttatccctaagacctggaaccaatctattgccctgcgactagaattatttggttgcgacatttactag

SEQ ID NO: 2426 - DNA, 999 bp, Artificial Sequence
  Description of Artificial Sequence: Synthetic coding sequence
atggatgacgcagtggctcccggccgcgaatacacctatgagtggtccatctccgaggactcaggccccacacacgatgacccaccttgcctgacccatatttattatagccacgaaaacctcatcgaggacttcaattctggcctgataggaccgctactgatatgcaagaaaggcactctcactgaaggtggcacacagaaaacattcgataaacagattgtactgctcttcgcagtgtttgacgagtccaagtcatggagccagagcagttccctgatgtacacggtgaacggttatgtgaacggcacaatgcccgacatcaccgtgtgcgcacatgatcacatctcctggcacttgttaggaatgtcgagcgggcctgaactgttttctattcatttcaacggtcaagtgttggaacaaaatcaccacaaggtgtccgctatcacactggttagtgctactagcactaccgccaatatgactgtggggccagagggcaagtggatcatatcttctctgacacccaagcatctgcaggcagggatgcaggcgtacatcgatatcaagaactgtcccaaaaaaacaagaaatctgaaaaagattaccagagagcagagacgccatatgaaacggtgggagtattttattgcagcagaagaagttatttgggattatgcgcccgtgattcctgccaatatggataagaagtacagatcccagcacttggacaatttctccaaccagataggtaaacactataaaaaagtgatgtacactcaatacgaagacgaatccttcaccaagcataccgtgaatccaaatatgaaagaggatggaattcttgggcccataatccgcgcccaagtgagggacactctgaagatcgtgtttaagaacatggccagccgcccatattccatatacccacacggcgttactttttcaccctatgaagacgaggtgaactcgagcttcacatccggaacaaccccttag

SEQ ID NO: 2427 - DNA, 1335 bp, Artificial Sequence
  Description of Artificial Sequence: Synthetic coding sequence
atggtgtcacaagccctgcggctgttgtgtttgctcctaggcctgcaggggtgcttagctgctgtcttcgtgacccaggaggaggcacacggcgtgctgcacaggagacgacgggcaaacgcctttctggaggagcttcggcccggcagcttagagagagaatgcaaggaagagcagtgctcgtttgaagaggcccgagagatcttcaaggacgccgaacgaactaaactattctggatatcctactcggatggtgaccagtgtgcatcgagcccctgccagaacggcggttcgtgcaaagatcagctccagagttacatttgcttctgtctgccagcattcgaaggaaggaactgcgaaacccacaaagacgatcagttgatctgtgtcaatgaaaatggaggctgcgagcagtattgctctgatcacaccggcaccaagaggtcgtgtcgctgtcatgagggctatagcctgttagcagatggcgttagttgcacgcctaccgtcgagtatccttgcggtaagattcctatcctcgaaaagaggaatgccagcaagccacagggaagaatcgtgggcggaaaggtgtgcccaaaaggggaatgcccttggcaggtactgctcctggtgaatggggctcaactgtgcggaggaaccttgataaataccatctgggtggtgtcagcagcccactgcttcgataaaatcaagaattggagaaacctaatagccgtgctaggggagcacgacctgtctgaacacgacggagacgagcagtccagacgcgtagcccaggtcatcattccgtcaacctacgtcccaggaaccaccaatcacgacatagccctgttgcgtttgcaccagcctgtcgtccttaccgaccacgtggttcccctttgcctccctgaaagaaccttttcagaacggacattggctttcgtgcgctttagtctggtgagcggctggggccagctcctggacagaggcgcaactgccctggaactcatggtcctgaatgttccacggctcatgacgcaggattgtttgcagcaaagtcggaaagtgggggacagtccaaacataacggagtacatgttttgcgccggctacagtgatggcagcaaagatagctgtaagggggatagcggaggcccccacgccacacactatcgggggacatggtatctgaccggtatcgtgtcctggggccagggttgcgccaccgttggacactttggagtgtacacaagagtgtcccagtacattgaatggctgcagaaactcatgagatccgagccacgaccaggggtgctgttgcgagccccttttccctag

SEQ ID NO: 2428 - DNA, 1401 bp, Artificial Sequence
  Description of Artificial Sequence: Synthetic coding sequence
atggtgagccaggcactaaggctgctctgtctacttctcggtttgcaaggctgccttgccgccggcggcgtcgccaaagcgagtggtggggagacccgggatatgccgtggaagccagggccccaccgagtgtttgtgactcaggaagaggcccacggagttctccatcggcgccgacgtgcaaatgctttccttgaggaacttcgaccaggatccctggagcgcgaatgcaaggaggagcaatgttcctttgaggaggccagggagattttcaaagatgccgagcggaccaagcttttctggatctcctatagcgatggcgatcaatgcgcctcttccccttgtcagaacggcggttcttgcaaagaccagctgcagtcctatatctgtttttgcttgccggcattcgagggacgaaactgtgagacccataaagatgatcagctcatctgcgttaatgagaatggggggtgcgaacagtactgcagtgatcacacggggactaagagatcatgtaggtgccacgaaggttactctctcctcgcagacggggtgagttgcacaccaaccgtagaatatccgtgtgggaaaatacctatccttgagaagcggaacgcttcaaaaccacagggaagaatcgtgggaggaaaggtgtgccccaaaggggaatgtccatggcaagtgctgctgctggtgaacggagctcagttatgcggaggaacgctcattaacaccatctgggtagtgagcgcagcccattgttttgataaaattaagaattggcgcaatcttatcgctgtcctcggagaacacgatctgtccgagcatgatggagacgaacagtcaaggcgagtggcacaggtgatcatcccctccacatatgttcctggcacaaccaaccacgacatcgcgctgctgcgcctgcatcagcccgtcgtgctgacggaccatgtggtgcctctctgtctcccagaaagaacattctccgaaaggactctggcttttgtcaggttcagcctcgtatccggttgggggcagttactggatcggggcgcaacagcactggagttgatggtgctcaatgtcccacggctcatgacacaggactgtctacagcagagccgaaaggtgggggatagtcctaatattactgagtacatgttctgtgcaggatattcagatggctccaaggactcatgcaagggcgactctggggggccccacgcgacacactatcgtggaacgtggtatttaacaggcattgttagctggggccagggatgtgccaccgtggggcacttcggcgtatatactagagtttcgcagtatatcgaatggctccagaagctcatgcgatccgaaccaagacccggcgtgttgctccgggccccctttccttag

SEQ ID NO: 2429 - DNA, 1194 bp, Artificial Sequence
  Description of Artificial Sequence: Synthetic coding sequence
atgggcaatgtgaatcgccagggacaacattgtcgtgactttattatggtatctcaggccctgcgactgctttgcctgttgctgggcctgcagggatgcttagctgctgacggggatcaatgtgcatctagcccatgtcagaacggaggatcatgcaaggaccagctgcaatcatatatttgcttctgcctgcctgctttcgaaggacggaactgtgagacccacaaagatgatcaactaatctgcgttaatgagaacggaggttgcgagcagtattgtagtgatcatacaggaactaagcggtcatgccgctgtcatgaagggtactccctactcgcggacggggtgagctgtacgccgacagtggagtacccgtgtggcaagattcctatcttggagaagcgcaatgcttcgaagccccaagggagaatagtcggcggaaaagtctgtccaaaaggggaatgcccttggcaagttctcctgttggtaaatggagcccagctttgtgggggcactctcattaacaccatctgggtagtctctgcagcccattgtttcgacaaaatcaaaaactggaggaaccttatagcagttttaggcgagcacgacttgtctgagcatgacggtgacgaacagtctcggcgcgtggcccaggtgatcattccttcaacttacgttcccgggaccaccaaccatgatatcgctttgctgcgactccaccagcctgtcgtgctaaccgaccatgtcgtgcccctgtgcttgccggaaagaaccttctccgaaagaacacttgctttcgtgcggttcagcctggtctcagggtggggacaactgctcgatagaggagctacggcactcgagttgatggtgttgaacgttcctagactgatgacacaggactgcctgcagcagtcccgaaaggtgggcgacagtccaaatattacagaatatatgttttgcgcaggttacagcgacggaagcaaggacagctgtaagggggactcagggggccctcatgccacccactatcgggggacttggtacctgactgggatcgtgagttggggtcaaggctgcgccaccgtgggacatttcggggtctacactcgcgtgagccagtatatcgagtggctccagaagctgatgaggagcgagccaagaccaggcgtgctgctcagagcccccttcccatag

SEQ ID NO: 2430 - DNA, 651 bp, Artificial Sequence
  Description of Artificial Sequence: Synthetic coding sequence
atgcggatccaggatcccggcaaggtcttcttcgggaacgtggatagttctgggatcaagcacaatatatttaacccacctataatcgcccgatatatcagactgcaccccacccactactctatccgctcaacactccgcatggaactgatggggtgtgacctaaactcctgctcgatgcccttagggatggaaagtaaagccatttctgatgcacaaattaccgcgtccagctacttcactaacatgtttgcaacgtggagtccatccaaggctcggttgcacctgcagggcagatcaaacgcttggaggcctcaggtgaacaatccaaaagagtggttacaggtggactttcagaagactatgaaggtgactggcgtgactacacaaggtgtgaaatctctgctcacatcaatgtatgtgaaggagtttctcatcagctcctctcaggatgggcaccagtggacactcttctttcagaacggtaaggtgaaggtcttccaggggaatcaggatagctttaccccggtagtcaattccctggatcccccgctcttgactcgttatttgagaatccaccctcagagctgggtccaccagatcgccctgagaatggaagtgctgggatgcgaggcccaggatctttactag

SEQ ID NO: 2431 - DNA, 7056 bp, Artificial Sequence
  Description of Artificial Sequence: Synthetic coding sequence
atgcagatcgaattgagcacttgttttttcctctgtctcctccgcttctgtttttctgccacgcgccggtattatctcggagccgttgagctttcctgggattacatgcagagcgacttgggcgagctgcctgtggacgcgcggtttccgcccagagtcccaaaatcatttcccttcaatacttccgtagtttacaagaagaccctctttgtcgagtttactgaccacctgttcaacattgccaagccacgtcccccctggatgggtctgctcggccccactatccaagccgaggtttatgacaccgtggtaatcaccctgaagaatatggcaagccatcctgttagcttacatgccgtgggcgtttcatattggaaagcctcagaaggagccgaatacgacgaccaaacctcccagcgcgagaaagaagacgataaggtcttccccggagggagccatacatatgtatggcaggtgttgaaagagaatggccccatggcctcagatcccctctgcctgacatacagctacctgtcccacgtggacctggtgaaagacctgaactccggtctgatcggcgccttactcgtctgtcgcgagggaagtttagcgaaggagaaaacccagacccttcacaaatttattctgctttttgccgtgttcgacgagggtaaatcctggcattccgagacgaagaattctcttatgcaagatagagatgcagctagcgccagggcctggccgaaaatgcacacggttaatggatacgtgaatcgcagtcttccagggctgatcgggtgtcataggaagtctgtatactggcacgtgatcgggatggggacaactcccgaggtgcatagcatcttcctagaaggtcatacattcctggtaaggaatcatcggcaagcatctctcgagatttccccaattaccttcctgacagcacaaaccctcctcatggatcttggacagttccttttattctgccacatcagctcacaccaacacgatgggatggaggcttacgtgaaggtcgactcatgccccgaggagccccaattgcggatgaaaaataacgaagaagccgaggattacgacgatgacctgaccgactccgaaatggatgttgtccgtttcgatgacgacaatagccctagctttattcaaatcagatccgttgcaaagaagcaccctaagacctgggtccactatatcgccgctgaggaggaagactgggattacgcacccctcgtcttggctcccgatgaccgcagctacaagtctcagtacttgaacaacggaccacagcgcataggcaggaagtataagaaagttcggtttatggcatatactgatgaaacattcaagacgcgggaggccatccagcatgagtctggcatccttggcccactgctctacggggaggtcggagacacactgttgattattttcaaaaatcaggcctctcgcccttacaacatttatccgcacggcattacagacgtgagacctctgtatagccgcaggcttcccaagggcgttaaacatttgaaggattttcccatcttgcctggcgagatctttaagtataaatggaccgtaactgtggaggacggcccaaccaagtcagatcccaggtgccttacccgctactacagttcgtttgtgaatatggaacgggacctcgcctccggcttgataggaccgcttcttatatgctataaagaatctgtggaccaacgcggcaatcagatcatgagcgacaaaaggaatgtcatccttttctccgtcttcgatgagaacagaagctggtacctcactgagaacatccagcgattcttgcctaacccagccggagtgcagctagaagatcccgaattccaggcctctaatatcatgcactccattaacggctatgtctttgattcattgcagctttccgtgtgtctccacgaggtcgcatactggtatattctgtctattggcgcccagactgattttcttagtgtctttttcagcgggtacacattcaaacacaagatggtgtatgaggatacactgacgctctttccattcagtggtgagactgtgttcatgtcaatggaaaaccctgggttatggatcttaggatgtcacaacagtgattttcggaataggggaatgaccgccctcctgaaagtaagtagctgcgacaagaatacgggggattattacgaagattcctacgaagatattagtgcatatctgttatctaaaaataatgccatcgaaccacgaagctttagccagaattcaaggcacccatcaaccagacaaaaacagtttaacgccacaactattcctgagaacgacattgagaaaactgatccctggtttgcccatcgcaccccgatgccaaaaatccagaatgtatcgtcttctgacctcttgatgctacttcggcagtcgccgacccctcatggactgtcactgtcagatcttcaggaggcaaagtatgaaaccttttcagacgacccttccccgggagctatcgattctaataattctctgtcagaaatgactcactttcgaccgcaattgcatcattccggagacatggtcttcacgccagaaagtgggttacagctgcgcttgaacgaaaaactgggcaccactgccgctacagaactgaaaaagcttgacttcaaagtgtctagcacctctaacaacctgatatccaccatacctagtgataaccttgccgccggaaccgacaacacatcctcgctcgggccaccgtcgatgccggtgcactacgactcacagttagacacaaccctttttggcaagaagtcatcaccactgaccgagtcaggggggcctctcagcctgtcggaagagaacaacgattccaaacttctcgaaagtgggttaatgaattcccaagaatcctcttggggtaagaacgtctcatcaactgagtccggtagactctttaaagggaagcgagcgcacggaccagccctcctgacaaaagacaatgccctctttaaagtcagcatatccttattgaagaccaataaaacaagtaataacagcgccacaaaccggaaaactcatatagatggtcccagcctgctgattgagaacagccctagcgtgtggcagaatatattagagtcagacacagaattcaagaaagtaacccccctgattcatgacaggatgctgatggacaagaacgccacggccctccggttaaatcacatgtcaaacaaaacaacaagctctaagaacatggagatggtccagcagaagaaggagggcccaattcctccagacgcgcaaaaccccgatatgtctttcttcaaaatgctgtttctgcccgaatccgcacgctggatccagcggacacatggcaaaaattcactgaactccggacagggccccagtcctaagcaactggtgagcttggggcccgagaagtccgtggaaggacagaatttcttgtctgagaaaaataaagttgtagttgggaagggggagttcaccaaagacgtcgggctgaaagagatggttttcccaagttcccgcaatctgtttctgacaaacctggacaacctgcatgagaataatacgcataaccaagagaaaaaaattcaagaagagatagagaaaaaggagacccttatacaggagaatgtggtcttaccgcagatccacacggtgactggcactaaaaacttcatgaagaacctgtttctgctcagtaccagacaaaatgtggaggggagctacgacggagcctatgccccggtcctccaggattttaggtcgctgaacgactccactaatcgaactaaaaagcataccgcccacttttccaagaagggggaagaagaaaaccttgaggggcttggcaatcagaccaaacagatcgtggagaaatatgcttgcactaccagaatttcccccaacaccagccaacagaatttcgtcacacaacgttccaaacgagcactaaagcagttccgcctgccactcgaagagacagaactggaaaaacgcatcatcgtggacgatacttccacgcaatggtccaaaaacatgaagcatctaaccccgagcactcttacacagatagactataacgagaaggaaaagggggccatcactcagtcccccctgtccgattgcctgacaaggtcccacagcatcccacaggctaaccgatccccgctccctatagcaaaagtgtcatcctttccctctatacgccccatctacttaacacgagtgctttttcaggacaacagcagtcacctgcctgccgccagttatagaaaaaaggactcgggcgtgcaagagtcttcgcacttcttacaaggcgcaaagaaaaataatttgtcactggcaattctcacgctggagatgacaggcgatcaaagagaggtgggctccctgggaacctcagctaccaactctgtcacttataaaaaagtggaaaacacagtgttgcccaagccagatcttcctaagacaagcggcaaagtggagctcctcccaaaagtgcatatctaccagaaggacctgtttccaacagagacctctaatggatctcccgggcatttggacttggtcgaaggctctttgcttcagggtaccgaaggagccatcaagtggaatgaggccaaccgccccggcaaagtgccgttccttagagtggcaaccgagtcgtcagccaaaactccgtctaaactcctggacccactggcttgggacaaccactacggcacgcagatccccaaggaggagtggaagagccaagagaagtcacctgaaaaaacagcctttaagaaaaaggatacgattctgtccctgaatgcttgcgaatcaaatcatgccatcgcagcaataaacgagggccagaacaagcccgagattgaggtcacatgggccaagcagggtaggacagagaggctttgctctcagaacccgcccgtgctcaagcggcatcagcgcgaaattaccaggacaaccctacagtccgaccaggaggaaatcgactatgatgatacgatctcagtagaaatgaaaaaggaagacttcgatatctacgacgaggatgagaaccagagtcccaggtcatttcagaagaaaacgaggcattactttatcgcagccgtggagagactctgggactacgggatgagttcttcaccccacgtgctgagaaaccgggcacagtccggttctgtgccccagttcaaaaaggtggtattccaagagttcacagacgggtccttcacgcagccattataccgcggggagctaaatgaacacctcggcctgctgggtccctacatccgcgctgaagtagaggacaacatcatggtgacctttcggaatcaggcttctcgaccctactccttctactcatcacttatctcttatgaagaagaccagagacagggagctgaacctcgtaagaactttgtgaagcccaacgaaactaagacttacttctggaaggtgcagcatcatatggccccaaccaaggacgaatttgactgtaaggcttgggcatacttcagtgatgttgacctggagaaggatgttcactctggtctcataggaccgctcctggtgtgccataccaatacccttaacccagcccacgggaggcaagttaccgtgcaggaatttgcactatttttcacaatattcgacgagacgaaatcttggtacttcacagagaacatggaaaggaactgccgggccccgtgcaacatccaaatggaagacccgacctttaaagagaattacagatttcacgcgatcaacgggtatattatggacaccttgcccggcttggtgatggcccaggaccaacgcattcgctggtacctgctgtcaatggggtctaacgagaacatccactccattcatttcagtggccatgtgtttacagtgaggaaaaaggaggagtataaaatggctctgtacaacctttaccccggggtttttgagactgtagagatgctaccctcaaaggcagggatttggagggtagagtgtttgattggggagcaccttcacgcaggcatgtccacattattccttgtgtactcaaataagtgccagacccccctcggcatggcctctggacacatcagagacttccagattaccgccagtggccagtatggacagtgggctccaaagctcgcccggctgcattactccggctcaataaatgcttggtccactaaagagccattctcctggatcaaggtggaccttctggcccctatgattattcacggcattaaaacccagggcgcccgccagaaatttagctcattatatatctcccaattcatcattatgtattccctagatggtaaaaaatggcagacatatcgcgggaattccaccggcactctgatggtgtttttcggcaacgtcgattcatcaggcatcaagcataacatctttaatcctcctatcattgcccgttatatccgcctgcaccccacacattattcaattcggagcaccctgaggatggaactgatggggtgcgatttgaatagctgctctatgcctctaggcatggagagcaaggctatcagcgatgctcagatcacagcaagtagttacttcacaaatatgtttgcaacatggtcaccaagtaaagccagactacacctgcaggggaggtcaaatgcatggagaccacaggtcaacaacccaaaggagtggttgcaggtggactttcagaagactatgaaggtcactggcgtgacgacccaaggcgtcaagtccctcctgacctccatgtatgtgaaggagtttttgatttcaagttcacaagacggacatcaatggaccctcttttttcagaatggcaaggtgaaagtattccaaggcaaccaggattcttttacccccgttgtgaactcccttgaccccccactgctgaccaggtacctaagaatccatccccagagttgggtgcatcagattgcactgcgcatggaagtgttagggtgcgaggcccaggatctatattag

SEQ ID NO: 2432 - DNA, 999 bp, Artificial Sequence
  Description of Artificial Sequence: Synthetic coding sequence
atggggcgacctctgcatctggtgttgctttctgcctcccttgcggggttgttgctactcggagagtctctgtttatacgcagagagcaagccaataacattctggcacgggtaaccagggcaaattccttcctggaagaaatgaagaagggccatctggagcgcgaatgcatggaggaaacatgttcttatgaggaggccagggaggtgttcgaagacagcgacaagaccaatgaattttggaacaagtataaggacggggaccagtgtgaaacctccccgtgccagaatcagggaaagtgcaaagatggattgggcgaatacacctgtacatgccttgaggggtttgaagggaagaactgcgagctctttacgagaaagctgtgcagtctggataacggtgactgcgaccagttttgtcacgaggagcaaaatagcgtggtgtgcagctgcgccaggggatacactttggccgataatggcaaggcatgcatccccactggcccatatccctgtggaaagcagacgctggagaggcgtaagcgcagtgtggcccaggccactagtagcagtggggaggccccagactccatcacttggaagccctatgatgctgccgacctggatcccaccgaaaatcccttcgacttactcgacttcaaccagactcagcctgagcgcggggataataatctgacacgtatagtcggaggccaggagtgtaaagacggggagtgtccgtggcaggctctcttgattaatgaggaaaacgagggattttgcggcggaactattctgagcgagttctatatcctgaccgcagctcattgcctgtatcaggctaagagatttaagggaaccggtaccaggtcgcggcggagagctgtccggcggtgtacccgctggcgttggagcagttccaccacaggttcccagcgcaggcccatgacctctacttcaccatgtagcggctccaggcctccctcccccagcgcttag

SEQ ID NO: 2433 - DNA, 1467 bp, Artificial Sequence
  Description of Artificial Sequence: Synthetic coding sequence
atgggtcgccccctgcatttggtgttgctgagtgcttcccttgccggtctactgctgcttggggagtccttattcattagacgtgaacaggccaacaatatccttgcacgagtgacccgggccaactcgtttctcgaagaaatgaagaaaggacacctggagagggagtgtatggaagagacctgcagctacgaagaagctagggaagtattcgaggactcagataagacgaatgaattctggaacaagtacaaggacggggatcagtgcgaaacctccccatgccagaaccagggcaagtgcaaagacggtctgggcgagtacacctgtacatgtctggaggggtttgagggaaagaattgcgagctctttactcggaaactgtgctctttggataacggcgattgtgaccagttttgtcacgaggagcagaattcggtcgtctgttcttgtgccagaggatacactctcgcagacaacggaaaggcctgcatacccaccggaccctatccctgtggtaaacagacactggaacgtagaaagagatccgttgcacaggccacgtctagcagtggagaggctcccgacagcataacgtggaagccgtacgatgccgccgatctggaccccacggaaaaccccttcgacttgctcgacttcaatcagactcagccggagcgcggcgacaacaacttaacacgaatcgttggcggccaggagtgtaaagacggggaatgcccctggcaagctttgctgattaacgaagaaaacgaaggattctgcggtggtaccatcctgagcgaattctatattctgaccgctgcacactgcctgtatcaagcgaagcgcttcaaagtgagagtgggcgatcgcaataccgaacaagaggagggtggggaggccgttcatgaggttgaagtggtgatcaagcacaatcggttcaccaaggagacatacgacttcgacatagcagtactgcggctgaaaactccaattaccttccgcatgaacgtggctccagcttgcttgcctgagcgcgactgggcggagagcactctgatgactcaaaaaacagggatcgtttccggcttcgggcggacccacgagaaaggcaggcaatccaccagactaaaaatgctggaggtaccatacgtggaccgtaatagctgcaaactctcttcctcattcatcattacccagaacatgttctgcgcaggttatgatacaaaacaggaggatgcttgccagggggattctggaggcccccacgtgacacgattcaaggatacttactttgtgacaggcatagtctcatggggtgaggggtgcgcacggaaggggaagtatggcatttacactaaggtgacagcctttctaaaatggatcgataggtcgatgaagacgcgaggcctgccaaaggccaaatctcatgctcctgaagtgatcacatctagtcccttgaaatag

SEQ ID NO: 2434 - DNA, 1005 bp, Artificial Sequence
  Description of Artificial Sequence: Synthetic coding sequence
atggggcgtccgttacacctggtgcttttaagcgccagcctggccggccttttactgttaggagagtcccttttcattagaagggaacaggcaaataatatcttagcaagagtgacacgggctaactcgtttctggaggagatgaagaaagggcatttggaacgagaatgcatggaggagacatgttcctatgaagaggcgcgggaggtgtttgaagattcggataaaacaaatgagttttggaataagtataaggacggcgaccaatgtgaaacctcgccttgtcagaatcaggggaaatgtaaagacggcctcggtgagtacacgtgtacttgccttgagggatttgagggcaagaactgcgaacttttcaccaggaagctctgttctctggataatggggattgtgatcagttttgccacgaagagcagaactccgtcgtgtgcagctgtgcccgggggtataccttagcagataatggtaaagcctgtatccccactggcccttatccttgcggcaaacagaccttggaacgacgcaagaggagtgtggcgcaggcaacttcaagttctggggaggctcccgattcgatcacttggaaaccatacgatgcagccgacctagatcctacagaaaacccatttgatctgctcgacttcaatcagacccagcccgaacgtggagacaacaatctcacaaggatcgtgggaggacaggaatgtaaggatggcgagtgtccatggcaggccctgttgattaatgaggaaaatgaagggttctgtggtggcacgatcctctccgagttctatatcctcaccgcagcacattgtctctatcaggcgaagagattcaaggtgcgagggaccggaactagatcccggcgcagagctgtccggaggtgcacacgttggaggtggagctcatcaaccaccgggtctcaacgaagacccatgacgtctacaagtccctgtagcgggtccaggcctccttccccatccgcctag

SEQ ID NO: 2435 - DNA, 1722 bp, Artificial Sequence
  Description of Artificial Sequence: Synthetic coding sequence
atgatcttcctgtaccaggtggttcattttattctgttcacttccgtgtccggggagtgcgtgacacagctccttaaggatacatgctttgaaggaggagatataacgactgtgttcacaccttccgcaaagtattgccaggttgtgtgtacttatcacccgcggtgcctgctgttcacgtttacggccgagtccccaagtgaggacccaacacgatggttcacctgcgttctgaaagactctgtgacagagactctcccaagggtcaataggacagcagccatcagcggttatagtttcaagcagtgtagtcaccaaatttccgtgaacaacatctgtttactgaagcatacccagactggaaccccaacccggatcactaagttggataaagtagttagtggattttctctaaagagctgtgcgctaagtaatttagcctgcattagggatattttccctaacaccgtttttgctgactcaaatatcgatagcgtgatggcacctgatgccttcgtctgcggccgtatatgtactcatcaccctggttgtctgttcttcacatttttctcacaagagtggccaaaggagagccagcggaatttgtgtttattgaagacaagtgagtcaggcttgcctagtacaagaattaagaagtccaaggccctgagcggcttttcgctgcagagttgccgccattccattcctgtgttctgccatagcagcttttaccatgacacagatttcctgggcgaagaactcgacatcgtggcagcaaagtctcacgaggcttgtcagaagctgtgtactaacgccgtgcgctgccagttcttcacatacactccggctcaagcttcgtgcaacgagggcaaagggaagtgttatctgaagctcagctcgaacgggtctcctacaaaaattctgcatggcaggggtggaatttctggctacacattgaggctgtgcaaaatggataacgagtgcactacaaagattaagccccgaattgtgggaggaaccgcctcagtaagaggcgaatggccctggcaggtcaccttgcatactacctcacccacccagcggcatctttgtggggggtcgattattggcaaccagtggattctaacagccgcccactgtttctacggcgtcgagagcccgaagatcctcagggtatacagcggcattctaaaccagtcagaaatcaaagaagatacctcatttttcggtgtccaggaaattattattcacgaccagtacaaaatggccgaatctggctatgacattgccctgcttaaactggagaccacggtcaactacaccgatagccaaagaccaatctgtctgcccagcaagggcgaccgaaatgtgatctataccgactgctgggtcaccggttgggggtatagaaagctgagggacaagatccaaaacactctccagaaggctaagatccctctggtaaccaatgaagagtgtcagaaaagataccgaggccataagatcactcataagatgatctgcgcaggctatagggagggcgggaaagatgcttgcaagggagattcaggcggtccgttgtcatgtaaacacaacgaagtgtggcatctcgttggaattacttcttggggagaaggttgtgctcaaagggaacggcccggagtatacacgaacgtcgtggaatacgttgattggatcctcgaaaaaacgcaggccgtatag

SEQ ID NO: 2436 - DNA, 1878 bp, Artificial Sequence
  Description of Artificial Sequence: Synthetic coding sequence
atgatcttcctctaccaggtggttcatttcatcctctttacttctgtatcaggagagtgtgttacccaacttctgaaggacacatgctttgaagggggagatatcaccactgtattcacaccttctgccaagtattgccaggtcgtttgcacctatcatccccgatgtctactgttcacctttacagctgagtcaccgagcgaggatcctacacgttggtttacttgtgtgctgaaagactcagtgacagagaccctaccaagagtgaatagaactgcagcgatctccggatactccttcaagcagtgctcccatcagatatctgcttgcaacaaggacatctacgttgacctagatatgaagggtattaactataactcttctgtcgccaagtctgcccaggaatgtcaggaacgctgcacagatgatgtgcattgtcattttttcacatacgcaaccagacagtttcccagtctggaacaccggaatatttgtctattaaagcatacccagaccggcacccctacgcggatcacaaaacttgacaaggtggtcagtgggtttagtctcaaatcttgcgcactgagcaacctggcgtgcatccgtgacatcttccctaataccgtttttgcagacagcaatatcgatagcgtgatggcacctgatgccttcgtttgcggcagaatttgcactcatcatcctggttgcttattcttcacctttttctcacaggaatggcccaaagaatcccaaaggaacctgtgtctcctcaagacctctgagagcgggttgccttccactcgaatcaaaaaatccaaagcactctctggtttcagcctgcaaagttgtcggcacagtatccccgtgttctgccatagctccttttatcacgacaccgacttcctcggggaggagctggatattgttgccgctaagtcacacgaggcttgtcagaaactgtgcacaaatgccgtccggtgtcagttcttcacctacacacctgctcaggcctcgtgcaacgaaggtaaaggtaagtgctatctgaagctgagctccaacggtagccccaccaagatcttgcatggaagaggggggatttcaggctataccttgcgtctgtgtaagatggacaacgaatgcaccaccaagatcaaaccaaggatagtgggtggcaccgcatccgttcgtggcgaatggccctggcaggtaaccctccacaccacatctcctacccaaagacatctatgcgggggtagcatcatcggcaaccagtggatcctcacagctgcccactgtttctatggcgtagaatcacccaaaattctgagggtgtacagtggcatcctcaatcagagcgaaatcaaggaggatacaagcttcttcggggttcaggagataatcatccatgatcagtacaaaatggccgagtcaggctacgatattgccctgctgaagttggagacaaccgttaactataccgatagccagcggccaatctgcctccctagtaaaggcgataggaatgtgatctacaccgattgttgggtcactggatggggataccgcaagctgagggataagatccagaacaccttgcaaaaggctaaaatcccattagtaaccaacgaggagtgtcagaagaggtaccggggccacaaaatcacccacaaaatgatctgcgcaggttatagggaggggggaaaagatgcatgcaaaggcgatagcggcgggccactcagttgtaagcacaatgaggtctggcacctcgtaggcattaccagttggggtgaaggctgcgctcagcgcgagaggcccggggtgtacaccaatgtggtggaatacgtggattggatcctggaaaagactcaggccgtctag

SEQ ID NO: 2437 - DNA, 633 bp, Artificial Sequence
  Description of Artificial Sequence: Synthetic coding sequence
tgatccggcttttccctgaaatcatgtgccctttccaatctggcttgtatccgagatatattccccaataccgtcttcgccgactctaacatagattcagtgatggcgcctgatgctttcgtttgtggccgaatctgcactcatcatcccggctgcctgttcttcacctttttctcgcaggagtggcccaaggaatctcagagaaacttatgtctcctgaagacatctgagtcaggtttgccttcaacacgtatcaaaaagagcaaggccctgagtgggttttcgctccagtcatgtagacacagtatccctgtcttctgtcacagctcattctatcatgatacggacttcctgggcgaggagctggacattgtcgctgccaagtcccacgaggcttgccaaaagctgtgtacgaatgcagtccgctgtcaattcttcacttacacaccagcgcaggcgagctgcaacgaaggcaagggaaagtgttacctgaaactcagtagcaacggatcacccacaaagatcttgcacggaagaggcggcatatccggctatacacttaggttatgtaagatggataacgaactgcgtggcgcccccatgaaaatatctggctggctcaaaacaagctag

SEQ ID NO: 2438 - DNA, 2199 bp, Artificial Sequence
  Description of Artificial Sequence: Synthetic coding sequence
atgagcgagacatctagaacagcgttcggtgggcgcagggctgtgcctcctaataactctaacgctgcagaggatgaccttccaacagttgaactccagggcgtagttccacgtggtgtaaacctgcaggagtttctgaacgtgactagcgtgcacttgttcaaggaacgctgggatacgaataaggtcgatcatcacactgacaagtacgagaacaacaagctaattgtgcgcaggggccagagtttctacgtgcagatcgacttctcgcgaccttacgaccctcgccgagacctgtttcgggtggaatatgtgattggcagatatcctcaggaaaataaagggacatatattccagttccgatcgtgtctgagctgcagtctggaaagtggggcgctaaaatagtgatgagggaggaccggtctgtcaggctaagcatccagagtagtcccaagtgcatcgtgggtaaattcaggatgtacgtggctgtctggactccgtatggtgttcttaggacttctagaaacccagagacagacacctacattctgtttaatccttggtgtgaggacgacgccgtttatcttgataacgagaaggaacgggaggaatacgtcttgaacgatataggcgtgatcttttatggcgaggttaacgatattaagacgaggagttggtcgtacggtcagttcgaagatgggatcttagatacatgtttatacgttatggacagagcccagatggacctgtccggccgcggcaacccaatcaaagtaagtcgagtaggcagcgctatggtgaacgctaaggacgacgagggcgtgcttgttggctcatgggacaatatttatgcatacggagtacctccatctgcctggaccggaagtgttgatatcctgctggagtaccgtagtagcgagaatccagtgcgctacggtcagtgttgggtgttcgcaggtgtgtttaacacgtttcttagatgtttgggtatcccagcacgcatcgtcacaaattatttcagtgcacacgataacgatgctaatctccaaatggacatcttcctggaggaagacggtaatgtgaattcaaagctgaccaaagattctgtgtggaattaccactgttggaacgaggcttggatgacaagaccagacctgcccgtgggatttggaggatggcaagcagtggatagcactccccaagaaaacagcgacggcatgtatcgctgcggtccagctagcgtgcaggctattaagcacgggcacgtttgcttccagttcgacgcaccctttgtgttcgcagaggttaattcagatttgatttatattaccgcaaaaaaagacggaacccacgtggtggaaaatgtcgatgccacacacataggcaagttgatagtaacaaagcagatcggcggcgacggcatgatggacatcaccgatacttataaatttcaagagggtcaagaggaagaaaggctagcgctggagactgcgctgatgtatggcgccaagaaaccactgaatacggagggagtgatgaagagcagatccaacgtggacatggactttgaggtcgaaaacgcagtcttgggcaaggatttcaagctgtccattacgtttcgcaataattcgcacaatcgctacacaatcaccgcgtacctctctgctaacattacgttctacactggcgtgccgaaggcagaattcaaaaaagaaacttttgatgtaaccctggaaccactctctttcaagaaggaggctgtgctgatccaagcaggcgaatacatgggccagttactggagcaggcatccctccactttttcgttaccgctcgaatcaatgaaacccgcgacgtgcttgctaagcagaaatccaccgtgcttaccattccagagattatcatcaaggtcaggggcactcaagttgtggggagcgacatgaccgtcactgtggagtttaccaatcccctgaaggagacattgagaaacgtatgggtgcacttagacggtcctggggtcacccgtccaatgaagaaaatgttccgcgagatcagaccaaatagcaccgtgcaatgggaggaggtatgccggccttgggtctctgggcaccgcaagttgatcgcttccatgtcttctgactctctgaggcacgtctatggtgagttggatgttcagatccagagacgtcccagcatgtag

SEQ ID NO: 2439 - DNA, 417 bp, Artificial Sequence
  Description of Artificial Sequence: Synthetic coding sequence
atgtcggagacctcccgaaccgcctttgggggacggcgcgccgtcccgcctaacaattcaaacgcagctgaggatgacctgcctaccgtcgagctgcaaggagttgtgccacgcggtgtgaacttacaggaatttctcaacgtcacttccgtgcatctgttcaaggagagatgggataccaataaagtggaccatcatactgacaaatacgagaataacaagttgatcgtgcgtcgtggtcagtccttctacgtacagatcgactttagtaggccttacgaccctaggcgagacttgtttagagtggagtacgtgatcggcagataccctcaggagaacaaaggaacttacatccccgtgcccattgtctccgagttacaaagcggcaaatggggcgccaagatcgtgatgagatag

SEQ ID NO: 2440 - DNA, 1881 bp, Artificial Sequence
  Description of Artificial Sequence: Synthetic coding sequence
atgagcgagacctctagaacagcctttggcggcagacgcgccgtccccccaaacaactctaacgccgcagaggatgatcttcctactgttgaattacagggggtggtgccacggggagttaacctccagggcagatacccccaagagaataaaggcacatacattccagttcccattgtgtccgagctacagagtggtaagtggggtgccaagatcgttatgagagaggatcgcagcgttaggctgtccattcagtcttcccctaagtgtatcgtgggaaagtttcgcatgtacgtagctgtgtggacaccctacggcgtgttgcggaccagtaggaacccagagactgacacatacattctgttcaatccatggtgtgaagacgatgcggtctacttggacaacgaaaaagaaagggaggaatacgtcttaaacgacattggcgttatcttctatggggaggtaaatgatatcaaaacacggagctggtcctatgggcagttcgaggacggcatcttggacacctgtctgtatgttatggatagggcacaaatggatctctccgggcgaggaaaccctattaaggtttctcgcgtgggaagcgccatggtcaacgcgaaagacgacgaaggcgtgctggtagggagctgggacaatatttacgcctatggagtgcccccatctgcctggacaggatccgtggatatcttgctcgagtatcggtcatctgagaatccagttcggtatggacagtgttgggtttttgccggtgttttcaatacgtttttgaggtgtcttggcattccggcgagaattgtgacgaactattttagtgcccatgataatgatgccaacttgcagatggacatatttctggaagaggatggaaatgtgaactctaagctgacaaaggacagtgtctggaactaccactgttggaacgaggcctggatgacgagacctgatctgcccgtggggtttggcggatggcaagctgtcgatagcacacctcaggagaatagcgacggtatgtatcggtgcggcccagcctctgtccaggcaataaagcatgggcacgtctgcttccagtttgatgcaccttttgtatttgctgaggtgaatagcgatctgatttacattaccgcgaagaaagatggaacacatgtggtggagaacgtggatgctactcacatcggtaagctcatcgtgacaaagcaaattggcggggacggcatgatggacataaccgatacctacaagtttcaggaggggcaggaggaagaacgcctggccttagaaaccgcccttatgtacggtgccaaaaagcccctaaacaccgaaggcgtgatgaagtcccggagcaacgttgacatggattttgaagtggagaacgctgtcctcggaaaagactttaaactgagcatcactttccggaataactcgcataacaggtacacaatcaccgcgtacttatccgccaacatcacgttctatacaggagttccgaaggccgagtttaaaaaggaaacttttgatgtgacactcgaaccgttgagcttcaaaaaggaggcagtactgatacaagccggcgaatatatggggcagctgctggagcaggctagcttacatttttttgttaccgcacgcattaatgaaacccgggatgttttagccaaacagaaatctacggtcttgacaattccagagatcattattaaggttaggggcacgcaagtggtcggatccgacatgacggttactgaagtgtgtcgtccctgggtgtccgggcatagaaaattgatagcatcgatgtcctcagattccctgcgacatgtatatggagagttagacgtgcagattcagaggagacccagcatgtag

SEQ ID NO: 2441 - DNA, 8835 bp, Artificial Sequence
  Description of Artificial Sequence: Synthetic coding sequence
atgactctgcgcttgctggttgccgctttgtgcgcaggaatcctggcggaagctcccagagtccgcgctcagcaccgggagcgcgtaacgtgcacccggttgtacgccgccgacatcgttttcttgttggacgggtcttcatctataggccggtccaatttcagggaggtccgcagttttctcgagggtctggtgctcccttttagtggggcggcctcagcgcaaggggttagatttgcaacggtccagtattctgatgatcctcgcaccgaatttggactcgacgccttggggtctggcggtgatgtcatccgcgcaataagggagctttcatataagggaggaaacacacgcacaggagctgcaattctccacgttgccgatcacgtgtttctccctcagctcgctagaccgggggttcctaaagtctgtattctgattaccgacggtaaaagtcaggaccttgtggacacagctgcccagaggctcaaaggccagggagtgaagctgtttgcagtgggcatcaagaatgcagatcccgaggagctcaagcgtgtcgcaagtcagccaacgagcgattttttcttcttcgtgaatgatttcagcatcctccgtactctgctccccttggtgagtcggagggtgtgtaccactgcaggaggcgtgcctgtgactagaccacccgatgattctacctcagctcccagggatctggtactatctgagccctcctcccagtcattaagggttcaatggacagctgcctccgggccagtcaccggatacaaggtacagtacacacctcttaccggactgggacagccgctgccttctgaaaggcaggaagttaacgttccagccggggagacctcagtgagattgcgtggcctgcggccattaacagagtatcaggtaactgtgatcgccctttatgctaattccataggtgaggctgtgtctggaaccgctagaacaacagctctggagggcccagaacttacaatccagaatactaccgcccacagtctgctagtcgcctggcgttctgtcccaggggcaacaggttaccgggtgacatggcgtgtcctaagcggggggccgacccagcagcaggagctcggccctgggcagggcagcgtcctgctgcgcgacttggagcctggcaccgactacgaggtcactgtgagcactctgtttggccggagcgttggccccgccacatctcttatggcaaggactgacgccagtgtagaacagacgctgcggccagttatactcggacctacctccattctgctctcctggaatctcgtgcctgaggcacgaggctatcggctggagtggaggcgggagacggggctcgagccacctcaaaaggtagtcctccccagcgacgtgaccagataccaactggatgggctccagcctggcacggagtacagactgacgctgtacaccctgctcgagggacatgaagtggccacaccagctacagttgtaccaacagggcctgagctcccagtctcccctgtaactgacctgcaggcaactgagctaccgggtcagagggtccgcgtatcctggtcacccgtgcccggcgccacgcagtatcgcattatagtgagatctactcagggagtggaacgaaccctggtactccctggctcccaaaccgcttttgatctggacgacgtgcaggctggtctgtcgtacactgttagggtctctgcccgcgttggaccacgggaagggtctgccagcgtgcttaccgttcggcgagaacctgaaacgccattggctgtccccggtctgagagtggttgtatctgatgccacgagggttcgcgttgcctggggacccgtgcccggcgctagtggcttcagaatttcatggtccacaggctcaggaccggagagcagtcagacgcttccgcctgatagcacggcaacggatatcaccggccttcagccaggcaccacctaccaagtggcggtctcagtgctgcggggccgagaagagggacctgccgccgtgatcgttgcccgtacggaccccctggggccagtccggacagtccatgtgactcaggcgtcctcttcatcggtgacaatcacctggacacgcgtgcccggcgccacaggatacagggttagctggcactccgcgcacggacctgaaaagtcccaattggtgtctggcgaggcaacagtggctgaactcgatgggcttgagccagacaccgagtacacggtgcacgtcagagctcatgttgctggcgtggacggacctcccgcatccgtggtggtgcggactgctccagagccagtgggaagagtgtctagactgcagatacttaacgcctcaagtgatgttctacgtataacttgggtgggggtcaccggagccactgcctaccgcctagcctggggtaggtcggagggagggcccatgcgccaccagattttgcctgggaacactgatagcgctgaaatccgcggactggaaggtggagttagctatagtgtccgggtgacagctctcgttggtgacagggaaggtacccccgtctcaattgtggtgacaaccccaccagaagcccctcctgctcttggtactctacacgtcgtgcagaggggcgagcattctcttagactcaggtgggagcccgtccctcgcgcccaggggtttcttctacactggcaaccagagggcgggcaagagcagagtcgggtgttgggcccagagttgagctcttaccacctggacggcctggaacccgccactcagtacagagtacgcctgtcggtattgggacctgcaggagagggacctagcgccgaagtgactgcgaggactgaatcacctcgcgtgccctctatagagttgcgcgtcgtggacactagcatcgatagtgtcactctggcatggactcccgttagtcgagcttctagctatatactttcctggagacctctgagggggcccggtcaggaggtgcctggctccccccaaacacttccgggtatctcctcatcgcagagagtcacagggctcgagcctggagtgagttacatcttcagcctcacaccggttctggacggcgtacgcggacctgaggcctctgttacccaaacaccagtttgcccccggggactcgctgacgtagtgttcctcccccatgccacgcaggacaatgctcatagagccgaagccacgcgacgggtcctggaacggctcgtgttggcattaggtccgctcggcccccaggccgtacaggtgggcctgttaagttattctcaccgtcccagtccactctttcctctcaacggctcacatgaccttggcattattctgcagcgaatccgtgatatgccctatatggatccgtccggcaacaatctaggtacagcagtagtcacagcgcacagatacatgctggcacccgacgcgcctggccggcgccagcacgtccccggcgtgatggtgttgcttgtggatgagccactgcgcggggacatctttagtcccatccgagaggcccaggctagtgggctgaatgtggtaatgttgggaatggctggggctgacccagaacaactgaggagacttgcaccaggcatggactccgtccagacattcttcgccgtggatgacgggccgtcactagatcaggctgtgtctggcctggctactgccctatgtcaagcatccttcactacccagccgcgacctgagccttgcccagtttattgccctaaaggccagaaaggggagccaggcgagatgggcctgcgaggccaggttggtccgcctggcgatcccgggctgccgggacgaaccggcgcccctggaccgcagggaccgccaggtagcgccactgctaaaggcgagcgcggttttccgggggctgatgggagacctggctcccccgggagggctggcaatcctggtacaccaggggctcctgggctgaaggggtctccgggccttcccgggcctagaggcgaccccggcgaacgcggcccacgcgggcctaaaggtgagccaggagcccccggacaggtaattgggggtgaaggtcccggattgcccggccgtaaaggggaccccggtccaagtggaccccccggccctagaggccccctcggggaccccggccccagaggcccgcccggcctcccaggcacagcaatgaagggcgataagggcgatagaggcgaacggggacccccaggacctggggaaggtggcatcgctcctggcgaacccggtttgccaggcctacccggctctcccgggccccaagggcctgtgggaccccctggcaaaaagggcgagaagggagacagcgaggatggagcacccggattgccaggtcagccaggttccccaggagagcaagggccacggggccccccaggagccatcggtcctaagggcgaccggggattccctggcccgttgggggaggccggtgagaagggagaaagggggccaccaggaccagctggttccaggggactccccggggtggccgggcggcctggggccaagggccccgaagggcctcctggaccaaccggccgccaaggtgaaaaaggggaacctgggagacctggggaccctgcagtggtgggacctgccgtagccggccccaagggagagaagggagacgtcggaccagccggaccccgaggggctacaggcgtgcagggcgaacgcggcccgcctggccttgttctgcccggcgaccctggccctaaaggggatccaggcgatcgagggcccatcggattgaccggaagagctggcccacctggtgactccggcccccccggagaaaagggtgatcccggaaggccaggcccccctggtccggtggggccccgaggtcgtgatggagaggtaggcgaaaagggggatgaaggccctcccggtgaccccggcttgccaggcaaggccggtgaacgtggccttaggggcgctcctggcgtgcgcgggcctgttggggaaaagggagaccagggcgatccaggtgaggatggcaggaatggaagccccgggagtagcgggcccaaaggggacagaggggagccagggcccccaggcccacctggacgactggtggacaccggtccgggcgccagggaaaagggggagcccggcgataggggccaggagggtccacgcggtccaaagggagatccggggctccccggtgccccaggcgaaagggggattgaaggattccgaggcccccccggccctcagggtgaccccggcgtgcgcggccctgctggagaaaaaggcgaccgggggccccctgggcttgatggaagaagcggtctggatggcaagcccggtgccgcaggaccttccggtcctaatggggctgctggtaaagctggagacccaggacgcgacgggctgcctggcttacgtggagaacagggcctgcctgggccaagcgggccccctggccttcccggcaaacccggagaagacgggaaaccaggcttaaatggcaaaaacggcgaacccggagacccaggtgaggacggccggaaaggcgagaaaggtgactccggagcttctggcagggaagggcgagatggccccaagggggagcggggggctcctggcattttagggcctcaagggcctcccggccttcctggccccgtcggcccgcccggccagggatttcctggagtacctggagggactggaccaaagggggatagaggtgaaacaggtagcaagggggaacagggcctcccaggagagcgggggctgcggggggaacccgggtctgtgcctaatgtggaccgccttctggaaacagcgggtattaaggctagcgctctcagggaaatagtagagacatgggatgaaagtagcggcagtttcctcccagtgcccgagcggcgcaggggacctaaaggagactcaggggaacaaggaccgcctggcaaagaggggccaatcggctttccaggtgaacggggcttaaagggcgacaggggcgaccccgggccccagggccccccggggttggctctgggtgagcggggcccccccggcccttccggacttgcaggagagcccgggaaacccggtatcccagggttgccgggtagagcagggggcgtgggggaggccggaagaccaggtgaaaggggagagcgaggagagaaaggagaacgcggggaacagggcagagatggcccgcctgggctccccgggacaccgggaccacctggccctccagggccgaaggtaagtgtggacgaacccggccccggcttgtccggtgagcaaggcccacccggactgaagggtgctaagggggagcctggtagcaacggcgatcaggggccgaaaggagacagaggcgtgcctggcattaagggggaccgcggagaaccggggccacgtgggcaggacggcaatcctgggctacctggcgagcggggtatggccgggcctgaagggaagccaggcctgcaagggccgagaggccctccgggacctgttggtggacacggagaccctggacccccaggcgcccctggactcgcaggacccgcaggcccacaaggcccttcaggattaaagggagaacctggagagaccggaccccccggccgtggactcacaggccccacaggtgctgtgggattaccaggacccccaggtccatcaggtctggttggaccccagggttctcctggactgccaggccaagtcggggagaccggcaagcctggtgcccctggtcgtgatggcgcgtctggcaaggatggcgacagaggcagtcccggcgtgccaggatccccaggcctgcccggacctgtggggcctaaaggggaacctggccctactggggctcctgggcaggctgtagtgggcttgccaggcgccaaaggcgaaaaaggtgcccccggcgggctggctggcgacctggtgggggagcctggagcgaagggtgacagaggtttaccaggccccagaggggagaagggcgaagctggaagagctggtgagcccggcgacccaggagaagatggtcagaaaggcgccccagggccaaaggggttcaaaggggacccaggggtgggcgtgccggggtcacctggacctccagggcctcctggggtgaaaggcgacctgggacttccaggtctgcccggagcgcccggggtggtcgggttccccggacaaacgggccctagaggtgagatgggacagcccggaccatctggtgaacgcgggttggcggggcccccgggaagggaaggcatccctgggcctcttggacctcccggccccccggggagcgtcggcccgcccggcgcgtccggcctgaagggagataagggtgacccaggggttgggctacctggccctcggggggaacgtggcgaacctggaatccgcggtgaggatggccgtccgggccaggaaggcccgagaggcctcactgggcctccaggtagccggggagaaaggggagagaaaggtgacgtcggctcagccgggcttaagggggataagggcgactctgcagttattctgggacctccaggccctaggggcgccaagggagacatgggggagcgtggccctcggggcctggatggcgacaaggggcctcgaggggataatggcgaccctggagacaaaggtagtaagggggagccaggcgataaagggtcagcgggcctcccggggctgcgcgggcttctgggtccgcagggacagcctggggcggccgggattcccggggaccccggcagccccggcaaggacggtgttccagggattaggggtgagaagggagacgtggggttcatgggaccacgtggactaaagggtgaacgtggcgtgaaaggcgcatgcggtctggatggcgaaaaaggtgataaaggtgaggctggcccccctggccggcccggattagccggccataagggagagatgggggaacctggcgtcccaggacagagcggcgcacctggtaaggaggggttgatcggcccaaaaggagatcgtggcttcgacggtcagccaggaccaaagggagaccaaggggagaaaggggaacgcggtactccagggataggaggctttcccggcccttctgggaatgacgggtcggcagggcctcctggtcctcctgggtcggttgggcctcggggccctgaggggctgcagggccaaaaaggcgaaaggggtccacccggcgaacgagttgttggcgcacctggggtcccaggtgccccaggagagcgaggagaacagggacgacctggaccagctgggccaaggggggaaaaaggagaggctgccttgacggaagacgacatacgcggttttgttaggcaagaaatgagtcaacattgtgcctgccagggacagtttattgcttcaggcagcagacccttgccctcctatgctgcggacaccgcagggtcccaattgcatgcggtccctgtgctgcgcgtgagtcatgcggaagaagaagagcgcgttccacccgaggacgatgaatattctgaatactccgagtactctgtggaagaataccaagaccctgaggccccttgggactccgatgacccatgttcgttacctctggacgaaggctcctgcactgcatacactctccgctggtatcatagagcagttactggatctacagaggcctgccacccattcgtgtacggcggctgcggaggcaacgctaacaggtttggaacccgcgaggcctgcgaaagacgctgtcccccgcgtgtggtacagtcccaaggcactggaaccgcccaggattag

SEQ ID NO: 2442 - DNA, 8739 bp, Artificial Sequence
  Description of Artificial Sequence: Synthetic coding sequence
atgaccttgaggttgctcgtggcagcactgtgcgcagggatcctggcggaggcacctcgcgtaagggctcagcatagggaacgcgttacttgcacaaggctctacgcagctgatatcgtcttcctgctcgatggcagctcttcaattggcagatccaacttcagggaagtccggtccttcctggaggggctggtcttgccgttttccggcgcagcttctgcccagggggttcgtttcgctaccgtccagtattccgacgatccacggaccgagtttggtttagacgccctgggctctggaggggacgtcattcgcgccatcagagaactatcatataaaggtggaaacacgagaacaggggctgctatcctccacgtggctgaccacgtctttctccctcagttggcacgcccgggagtgccaaaagtgtgtattctgatcacagacggcaagtcgcaggacctcgtagacactgccgctcagcgcttgaaaggccaaggcgttaaactgtttgccgttggtattaaaaatgctgaccctgaagagctgaagcgcgttgcctcccagcccacttctgacttctttttttttgtgaatgacttcagtatcctccgcaccttgcttccactcgtttccagaagggtctgcaccacagcggggggcgttcccgtgacccggcctccggatgacagcacatcagccccaagggatctggtgctgtctgagccttctagccaaagcctaagagtgcagtggacagctgcatctgggcccgtgaccggatataaggtgcagtacacaccgctgaccggcctgggacaacccctgccctcagagaggcaagaggtcaatgtgcccgccggggagacaagcgtccgactacgaggcctccgccccttgaccgaatatcaagtgacagttattgcactttacgcaaactcaatcggcgaggctgtttccgggacagctaggaccaccgcactggaagggcccgagctcactattcagaatacgacagcacactccctgctggtcgcgtggaggtccgtaccaggcgccaccggctacagagtgacatggagggtgctaagcggcgggcctacacagcaacaggagctcggtccaggacagggctccgttctgcttagggacctggagcccggaaccgactacgaggtgaccgtcagcaccctctttggtcggtccgtggggcccgctacaagcttgatggccagaacagacgcttccgtagaacagaccctgcgaccagtgattcttggccccaccagtattctactctcttggaatctcgtacccgaggctcgggggtatcggttagagtggagaagagaaaccgggctggagcctcctcagaaggtagtgctcccctcagacgtcaccagatatcagctggacggcctgcagccagggactgagtatcgactgacactttacacactcttggaggggcacgaagtggccacccccgccaccgtggttcctactggtccggagctgccagtgtctcctgttaccgatctgcaagcaacagagttgcccgggcagagggtaagagtgtcctggagccccgtgcccggtgccacccagtaccgtatcattgtaagatcgacccagggtgttgagaggactctcgtccttcctggatctcagaccgcctttgacctcgatgacgtgcaggcagggctatcttatacggtcagagtgtccgcaagagtgggtccccgggagggctctgcctcggtgctaacagttaggcgcgagccagagactccgctggccgtgcctgggttgcgcgtcgtggtctcagatgccactagggtgagagtcgcttggggccccgtccctggtgcatccggatttcgaatatcttggtctacaggctcgggccccgagtcatctcagaccttgccccctgattctacagcaacagacattactgggttacaacctggcaccacttatcaagtggctgtgagtgtcctacgcggaagggaagaaggcccagcggcagtgatagttgccaggacagacccactcggaccggtgcggacagttcatgtgactcaagctagctccagcagtgtcaccatcacttggacccgggttcccggcgctactggttatcgggtctcgtggcacagtgcccacggtccagagaaatctcagctggtgagtggggaagccacagtggccgagcttgacggtcttgaacccgacaccgaatacactgttcacgtgcgcgcacacgtggctggagtagatggacccccagccagtgtggtggtccgtacagcacctgagccggtcggacgggtgtcacggctccagatccttaacgccagcagcgatgtgctcagaatcacatgggtgggcgtcaccggcgccaccgcctatcgcctcgcttgggggaggagtgaaggggggcccatgcggcaccagatactccctggcaataccgattccgcagagatccgcggcctcgagggcggcgtctcctacagcgtgcgtgttaccgccctcgtgggcgaccgcgaaggaaccccagtctcaattgtagtaactactcctcccgaagccccaccggcgctgggcacgcttcacgtcgtccagcggggggagcacagcttgagactcaggtgggagcccgttcctagagcccaggggtttttactccactggcagcctgagggcgggcaggagcagtctcgagtgttgggccctgaactctcctcctatcatttagacggcctggaaccagcgacgcagtatagagtgcgattgtctgtgctgggccctgctggcgagggcccgagcgcggaagttacggctcgaacagagagtcccagagtgccaagtatcgaactcagggtcgtggacacctctattgactcggtgaccctagcatggacacctgtgtctagggcttcctcctatattctgtcctggcgaccgcttagaggaccaggccaagaagtgccgggttccccccagacactgcccggtatttcaagcagtcaacgagtcaccggtctagagcctggcgtctcctacatcttcagtcttacccctgtcttggacggtgtgaggggaccagaggcttccgtaacccagacccctgtgtgcccacgaggattggcggatgtggtgttcctgcctcacgccactcaagacaatgcacatcgggctgaggctaccagacgcgtcttagagaggcttgtactggccttgggtcccctgggaccgcaggccgtgcaagtaggacttcttagctatagccaccgtcccagtccactatttcccctgaatggatcacatgacctaggtattatactgcagcgcattcgggacatgccctatatggacccatcgggcaacaacttaggcacagccgtggttactgcccatcgctacatgttagcgccagacgcgcccggacgcagacaacacgtccccggcgtcatggtgcttttagtggacgaaccactgagaggggacatattctcccctatccgggaggcacaggcctctggtcttaatgtggtgatgttggggatggctggcgccgaccccgaacagctccgaaggctggccccaggcatggactcagtgcagaccttttttgcagtcgatgatggtccatccctggaccaggctgtgtctggactcgctaccgcactttgccaggcgtcctttactacccagcccagacccgagccttgccccgtctactgccctaaaggacaaaaaggggaacctggcgaaatgggtcttcgtggtcaagttggcccccccggcgaccccggtctccccggtcggactggcgcccccgggccgcagggacctccggggtccgcgaccgccaagggcgagcgcggtttccctggagccgatgggcgccctggctcacctggccgcgctggaaatccaggtacccctggggccccaggcctgaaaggttcaccaggattaccaggacctcgcggggatcccggcgagcgcggccctaggggcccgaaaggcgagccaggagctcctggtcaggtcatcggcggcgaggggcccgggctcccgggacggaagggagaccccggcccgtctggccctccaggcccacgggggccactcggtgaccccggcccgcgaggaccgccgggcctgcctggcactgccatgaaaggcgataagggagataggggggaacgaggacctccaggcccaggtgagggtgggattgctcctggtgaaccaggactgcctgggctgcccggtagtcccgggcctcagggccccgtgggtccacccggaaaaaagggggagaaaggggattcagaggatggggcacccggacttccggggcagcctggcagccccggcgagcaggggcctagggggcccccaggtgccattgggccgaagggtgatagagggttccctggtccactgggcgaagcgggagaaaaaggcgaacgggggcctcccggccctgccggatcccgaggtcttcccggggtcgcgggacgacccggtgctaaggggccggagggacccccaggcccgacgggccgacaaggtgaaaagggtgagcccggtaggccgggggatcccgccgtcgtggggcccgcagtcgcgggtcctaaaggtgaaaaaggggatgtgggacccgcgggaccacggggcgccacaggtgtgcagggagagcgcggaccgcctggcttagtgctgccaggggacccggggcctaaaggagatccaggcgaccgcgggcccattggtctcaccggaagagcaggtcccccaggcgatagcgggccgccaggggaaaagggagaccctggccggcccggcccccccggcccagtcggaccgagaggccgagatggcgaagtgggtgagaaaggagacgaagggccaccaggcgatcctggactgccaggaaaagccggagaaaggggcctacggggcgcacccggtgtgagagggcccgtcggagaaaaaggcgaccagggcgacccgggcgaagacggaagaaacggtagtccaggatcatctggtcccaagggagaccgcggcgaaccagggccaccaggtccacctggccggctcgttgatacggggccaggagctagggagaaaggcgaacctggggatagggggcaggagggacctcggggcccgaagggcgatccaggtctgcccggcgctcctggagagcgcggaattgaaggatttcgagggccgccaggcccccagggtgacccgggcgtaaggggccctgctggcgagaagggggaccggggcccacctggccttgacggcaggtcgggtctggatggaaagcctggtgctgccggccccagtggcccaaacggagctgccgggaaggcgggagacccgggaagggatggactgccaggcctgaggggcgagcaggggttgcccggcccatccggacctccgggcctcccaggaaagcctggggaggatggaaaacccgggcttaatggcaagaatggagaacctggcgaccctggggaagatggtcggaagggtgagaaaggtgatagcggcgcttcgggcagggaaggattcccgggggtaccaggcggcacgggacccaaaggcgaccggggggaaacaggatccaagggcgagcaggggctgcccggtgagaggggcctgaggggggaaccgggctcagtgcccaacgttgacagactgttggagaccgcagggatcaaggccagtgctttgcgggagatcgttgaaacttgggatgaatcctctggaagcttccttcctgtgccagagaggcgccgaggtcctaagggcgacagtggcgaacaggggccacccgggaaggagggtcccattggctttcctggggaaagaggcctaaagggcgatcgtggcgaccccggccctcagggcccgcccggcctggccctaggggaacggggacctccaggtcctagtgggctagccggtgagccgggcaaaccaggaatccccgggctgcctggccgggcaggtggagtgggagaggccggacgcccaggcgagcgaggagaacgaggcgaaaagggtgagagaggcgagcaggggagagacggcccacctggcctgcctggtacacccgggcctcccggcccccccggccctaaagtatccgtggacgaacccggacctggcttaagcggcgagcaaggacccccagggctgaagggtgccaagggggaacctggcagtaatggagaccagggccccaagggcgatcgcggagtgccgggcattaagggagatagaggggaaccaggccctcggggacaggatggtaatccaggtttacccggcgaacggggcatggctgggccagagggcaagcctgggctgcaggggccacgcggcccccccgggccagtgggcgggcacggagacccaggcccgcccggagcccccggcctggcaggtcccgctggccctcaggggcccagcgggctgaagggagaacccggcgagactggcccccctggcaggggtctgactggaccaacgggcgccgtgggcctgcccggacccccggggccctctggccttgtgggccctcaggggtcacccgggctccccggacaggtcggagaaaccggaaaacctggtgcgcctggccgggatggtgcctcaggtaaagatggtgataggggaagccccggcgttcccgggagccccgggctgccaggcccagtgggtccgaaaggggagcccggtcccacaggcgctccaggccaggccgtggtgggcctgccaggcgccaaaggtgaaaagggcgccccaggaggcctagcgggcgacttggtcggagaaccaggcgccaaaggcgatcggggcctgccagggccgcggggcgagaagggtgaagccggtcgggccggagagccaggagaccccggtgaagatggccagaagggcgcgccaggacccaagggattcaagggcgatcccggcgttggtgtcccaggctctccaggtcctcccgggccacccggcgtgaaaggagacctcggtcttccaggtctgccaggtgcccccggcgttgtcggcttcccagggcagaccggcccgcgcggcgaaatgggtcaacctgggcctagtggggagagaggcctcgctggcccaccaggtagggaaggcattcctggaccactcggcccacccggaccacctggctctgtgggtccccccggcgctagcggcttaaagggcgacaaaggcgacccgggcgtcggccttcccggcccccgcggcgagaggggcgagccagggatccgaggcgaagatggccggccagggcaggaagggccgcggggtcttacgggaccacccgggagcagaggagaacggggagagaaaggcgatgtggggagtgccgggctgaaaggagacaagggagactccgctgtgatcctggggcctcctggaccccgcggcgctaagggggatatgggggagaggggaccacgggggctcgatggggataagggccctcggggagacaacggggatcccggagataagggttccaagggtgaacccggcgataaaggcagtgctgggcttccaggtctgcgcgggcttttagggcctcaaggccaacctggcgcggcgggaattcccggagacccaggctccccagggaaggatggagttcctggcattagaggagagaagggcgatgtgggctttatgggtcctcgcggactcaagggggagcggggggtgaagggcgcctgtggactggacggggaaaagggcgacaagggagaagccggccccccagggcgaccaggcctcgccggacataagggggagatgggggagcccggtgtgcccggtcaatcaggcgctcctggtaaggaagggttaattggccctaaaggcgacagaggctttgatggtcaacctgggcccaagggagatcagggcgaaaaaggcgaacgcggcaccccaggaatcgggggtttcccaggcccatccggtaacgatggcagtgccggacctcctggcccacctggtagcgtcggcccccgaggccccgagggactgcagggccagaagggtgaacggggccccccaggtgaaagggttgttggcgcaccaggggttcctggcgctcctggcgagcgcggggaacagggcaggcccgggcctgctggtccccggggagagaagggggaagctgctcttacggaggatgacatccgtggttttgtgcgacaggaaatgtctcaacactgtgcctgccagggccagtttatcgcctccggatctcggccactcccatcctacgcagcagatactgcgggttcccagttacacgccgttcctgtgctgagagtctcccacgccgaagaagaagagcgcgtgcctccagaggacgacgagtactccgagtacagcgagtactctgtggaggagtatcaagaccccgaggccccatgggacagtgatgacccctgttccctccccctggacgagggctcttgcacagcctataccctcagatggtatcaccgggcagtgactggcagtaccgaggcctgtcatccgtttgtgtatggaggctgcgggggcaacgcaaatcgctttggaacccgtgaggcctgcgagaggcggtgtcctccccgcgtcgttcagtctcaaggcaccggtactgctcaggactag

SEQ ID NO: 2443 - DNA, 435 bp, Artificial Sequence
  Description of Artificial Sequence: Synthetic coding sequence
atgtggctgcagagcctactgttactgggtactgtggcctgctcaatcagtgctccggccaggtctccttctccaagcactcagccgtgggaacatgtgaacgccatccaggaggccaggcggctcctaaacttgagtcgagacaccgccgccgagatgaatgaaaccgtggaagtcatttcagagatgttcgaccttcaagagcccacttgtctgcagaccagattggaactgtacaagcagggcttgcgagggtctctgacgaagcttaaaggaccacttaccatgatggctagtcactataaacaacactgtccacccaccccagagacaagttgtgccactcaaattatcaccttcgagagcttcaaggaaaaccttaaagatttcttactggttattcccttcgattgctgggagcccgtacaggagtag

SEQ ID NO: 2444 - DNA, 1218 bp, Artificial Sequence
  Description of Artificial Sequence: Synthetic coding sequence
atggaagcctcctttgtgcaaaccaccatggctcttggtttgagctccaaaaaagcttctagtcgcaacgtggcggtcgaaagaaagaacttaattaccgtttgccggtttagcgttaaaacccttctcgaaaaatacaccgctgaacctattgacgatagttctgaagagtttgtaaacttcgccgctatcctggagcagatactgtcacaccggttcaaagcctgtgcacctgccggtccagtgtcatggtttagtagcgatggccagagaggcttctgggactacatcagattagcatgcagcaaggtgcccaacaactgcgtgagcagcattgagaatatggagaatatctcaacagctagggccaaaggacgggcatggatcagggtcgctctcatggagaaacggatgtcggagtacattaccaccgccctgcgggatactaggactacccgccgtttctatgactcaggggctataatgctgcgcgacgaggctaccattttaaccggtatgctgatcggattatctgccatcgatttttctttttgcctcaaaggagaggttcttgacggaaaaactcccgtggtgatcgactacactccctacctaaagttcacgcagtcttatgactacctaactgacgaggaagaacggcactctgccgagagttccacctccgaagataactctcctgaacacccatacctgcctcttgtgaccgatgaggattcttggtactccaagtggcacaaaatggagcagaaattccgcattgtctatgcgcaaaagggttacctagaagaactggtgcggcttagagagagtcaactcaaggatctagaagccgaaaatcgcaggctccagctgcagctcgaggaggctgccgcccagaatcagagggaaaaacgcgagctcgagggggtgatcctagaactccaggagcagctcacaggtctcattcccagcgaccatgctccactggcccagggctccaaggagctgacaacgccactagtgaatcagtggccctctctagggactttgaacggcgctgagggggcgtccaactccaagctatacagacgacatagctttatgtctacagagccactgtcagccgaagcatcattgtcgtctgattcccagcgcctcggtgaggggacaagggacgaggagccctggggccccatcggtagttcagaacctaactag

SEQ ID NO: 2445 - DNA, 603 bp, Artificial Sequence
  Description of Artificial Sequence: Synthetic coding sequence
atgtccccagagccggccctatcacctgctctgcagctgctgttatggcactccgcactgtggacggtccaggaggccacgcccttgggtcccgcatcctccctcccgcagtctttcctcctcaaatgtctggagcaggtccggaaaatccagggagatggcgctgctctgcaggagaagctttgcgcaacctacaagctgtgccaccccgaggagctggtgctgctcggacacagtctcggtattccctgggcacctttgtccagctgcccaagccaggcccttcaactggctgggtgcctgtcccagctgcatagtgggctgttcttgtatcagggcctgctgcaagctctcgaggggattagtcctgagctgggacctactctggatacattgcagctggacgtggcggattttgcaactaccatctggcagcaaatggaagagctgggcatggctcctgcattgcagcctacccaaggggcgatgcctgccttcgctagcgcctttcaaaggagagctggtggcgtcctggtagcctcccatttgcaatcctttttagaagtttcctaccgcgttctgcggcatctggcgcagccttag

SEQ ID NO: 2446 - DNA, 516 bp, Artificial Sequence
  Description of Artificial Sequence: Synthetic coding sequence
atggcagggcctgcgactcagagccccatgaagctgatggccctgcaattactgctgtggcactccgccctctggaccgtccaggaagctacacctttgggccccgcctcttcattgccacagagctttcttttgaagtgcctggaacaggtcaggaagatacaaggggacggggccgccctgcaagaaaagctcgtgtccgaagccgggtgtctgagccagctccacagcgggctcttcttgtaccagggcctgctccaagcactggagggaatctctccagaactggggccgacactggacaccttacagttagacgtggcagacttcgctacaaccatttggcaacagatggaagagttgggaatggctcctgctcttcagcctacgcagggcgctatgccagccttcgcctctgcctttcagagaagagctgggggggtcctcgtggcctcccacctgcagagctttcttgaggtgtcttatagggttctgaggcatctggcgcagccttag

SEQ ID NO: 2447 - DNA, 615 bp, Artificial Sequence
  Description of Artificial Sequence: Synthetic coding sequence
atggcaggtccagcaacacagtcgcctatgaagctaatggccctgcagctactgctgtggcatagtgccctctggacggtgcaagaggccacgcctctgggcccagcctcctccttgccccagagctttctgctgaaatgcctggaacaggtgcgcaaaattcagggcgacggggccgcactgcaggagaagctatgcgctacctataagctgtgtcatcccgaagagttggtgttgctcgggcactctctaggaatcccttgggccccactctcttcatgtccctctcaggccctgcaactggccggatgcctcagccagctccactcagggctcttcctataccagggcctgctccaggctttagaaggcatttcccctgagctgggtccgacacttgataccctccagctggatgtggcggacttcgcaaccaccatctggcagcagatggaggagctcggcatggccccggccttgcagccaacgcagggtgcgatgcctgccttcgctagtgcgttccagcgacgggccgggggcgtcctggtggcctctcaccttcaatccttcctcgaggtgtcataccgtgtactcagacacctggcacagccctag

SEQ ID NO: 2448 - DNA, 3696 bp, Artificial Sequence
  Description of Artificial Sequence: Synthetic coding sequence
atgaggctgttggccaaaattatatgtctaatgctgtgggccatctgcgttgccgaggactgcaacgagctcccacccaggagaaatacagaaatcttgacaggatcttggtcagaccagacttatcctgaaggaacccaggcgatttacaaatgtcgacctgggtaccgcagcctcggtaatgttatcatggtgtgtaggaaaggagagtgggtggcgttaaacccacttcggaaatgtcaaaaacgaccctgcggtcacccaggtgataccccctttgggactttcacgctcacaggcggtaacgttttcgagtatggtgtgaaggcagtgtatacctgtaacgaaggttatcagttacttggcgagatcaactaccgcgagtgcgacactgacggttggaccaacgacatccctatctgtgaagtcgtcaagtgtttgccggtaaccgctcccgaaaacggaaagatagttagcagtgccatggaaccagatcgggagtaccactttggccaggctgtgagattcgtgtgcaactctggatacaagatcgaaggagatgaggaaatgcactgttcagatgatggcttttggagtaaggaaaaacctaaatgcgtcgaaatctcttgcaaaagccccgacgtaataaatggtagccctatctctcagaagatcatctataaggagaatgagcggtttcagtataagtgcaatatgggatacgaatattccgaaaggggcgacgcggtgtgtaccgaaagtggttggcgtccgctgccaagctgtgaagagaagtcttgtgacaacccatacattcccaatggtgactacagtccacttcgtatcaaacatcgaactggtgacgagatcacatatcaatgccgtaacggtttttaccctgctaccagaggaaataccgcgaaatgcacttctaccggctggattccagctccacggtgtactctcaagccgtgcgactaccccgatatcaagcacggcgggctctatcacgaaaacatgcgccggccgtatttcccagttgctgtgggcaagtactactcatactactgtgacgagcactttgagactccaagcggcagctattgggaccatatccattgtactcaggacggatggtcccccgcagtgccatgcctgagaaagtgctactttccttatctcgaaaatggttacaaccagaatcacggcagaaaatttgtacagggcaaatcaatcgacgtggcgtgtcatccaggctacgccctgcccaaagctcagactacagtgacatgtatggaaaatgggtggtcccccaccccccggtgtattagggtcaaaacttgttcaaagagctccatcgacattgagaacggcttcatttctgaatcacagtacacttatgctctgaaggagaaggccaagtaccagtgcaagctcggttacgtgacagccgatggcgaaactagcgggtccatcacttgtggcaaagacgggtggtcagctcagccaacttgtatcaaaagctgcgacatccctgtctttatgaatgcacgcaccaaaaatgatttcacttggttcaaactgaacgacaccctggattacgagtgtcacgacggctacgaaagtaacacaggctccacaactggaagcattgtatgcgggtataacggctggagtgaccttcctatttgctacgagcgggaatgcgagctgcctaagattgacgttcatcttgttccagataggaagaaggaccaatacaaagtgggggaggttctcaaattctcttgcaagcccggatttaccattgtaggacctaatagtgtacagtgctatcacttcggccttagcccagacctgcctatctgcaaggagcaggtgcagtcctgcggaccacccccagagctgctgaacgggaacgtgaaggagaaaaccaaagaggaatatggccatagcgaagtggtggaatactactgtaatcctcgcttcttgatgaaaggccctaataaaattcagtgcgtcgatggggaatggacaacgttgccggtgtgtatagtagaggagtcaacctgtggggatatccccgaactcgaacacggctgggcacagctgagtagccccccgtactactatggggatagcgtggagttcaattgctccgaatccttcacgatgattggtcaccgatctatcacctgtattcacggggtgtggacgcaattaccccaatgcgtggccatcgataagctaaaaaaatgcaagtcgtcaaacctgataatcttagaagagcacctaaagaacaaaaaggagttcgaccacaatagcaacatcaggtacagatgcagaggtaaagaggggtggattcataccgtatgtattaacggacggtgggaccctgaggtgaactgttcaatggcacagattcagctctgcccgcccccccctcagattcccaatagccacaatatgaccaccactctgaactatagagacggggagaaggtgagtgttctatgccaagagaactaccttatccaggagggggaggaaatcacatgcaaagacggcaggtggcagtctatcccactctgcgttgaaaagatcccatgctcacagccaccacagatcgagcacgggaccatcaacagctcaagatcttcccaagaaagctacgcgcatgggaccaagctgtcatacacatgcgaaggcggttttagaatctctgaggaaaacgagacaacttgctatatgggaaaatggtccagtccaccacagtgcgaaggcctcccttgtaaatcccctcccgagattagccatggagtggtagcccacatgtccgattcataccaatatggtgaggaagttacctacaagtgctttgaagggtttgggatcgacggtcctgcaatagcgaagtgcctcggtgaaaagtggtcccatcccccctcgtgtattaaaacagactgtttatcactcccttcatttgagaatgcaatcccgatgggcgaaaagaaagacgtttataaagctggagagcaggtgacttacacctgtgcaacttactacaagatggacggagcatcaaatgtcacctgcatcaattcgaggtggaccggccggccaacgtgtcgggatacttcatgcgtgaatccacctacggtccagaatgcgtatatagtctcacgacagatgtctaagtatccatcgggtgagcgagtccgataccagtgccgcagtccatatgaaatgttcggcgatgaagaggttatgtgcctgaatggcaactggacagagcccccccagtgtaaagattctaccggtaagtgtggcccaccgcctcctatcgataatggcgacattacctcatttccgctgtccgtctacgctcctgcttcatctgttgagtaccaatgccaaaatttgtaccagttggaaggtaataaacgaataacctgtcgaaacggacaatggagcgaaccgcctaaatgtctgcatccatgcgtgatttctcgagagataatggagaactacaatattgcattacgctggaccgctaaacaaaaattgtactcccggacaggggagtctgtggagtttgtctgcaagcgaggataccgcctctcctctagaagccataccctaagaactacttgttgggacggaaaactggagtatcccacatgtgccaagcgatag

SEQ ID NO: 2449 - DNA, 1350 bp, Artificial Sequence
  Description of Artificial Sequence: Synthetic coding sequence
atgagacttctggctaagataatctgccttatgctatgggctatctgcgtggccgaggactgtaacgagcttcccccgcgtcgtaacactgagattctaaccggctcttggagcgatcaaacataccctgagggtacccaggccatatataaatgtagacccggctataggtcattaggaaacgtgataatggtatgtcggaagggcgagtgggtggctctcaacccccttcggaagtgtcaaaaaagaccctgtgggcacccaggcgacactccatttgggacttttacattaaccggggggaacgtgttcgaatacggagtaaaggccgtgtatacttgtaatgagggataccagcttctcggtgagatcaactatcgcgagtgtgacactgatggatggaccaacgatattcctatttgcgaggtggtgaaatgcctgccagtgactgccccggaaaatgggaagatcgtttcttctgcaatggaacccgaccgggagtaccacttcggccaggcagtccgcttcgtatgcaactctggctataaaatagaaggagatgaggaaatgcattgcagtgatgatggcttctggagtaaagaaaagccaaagtgtgtggaaatctcatgcaagtctcctgatgtgattaacggctccccaatcagccagaagatcatttataaagagaacgagcgcttccaatataagtgcaacatgggctacgagtactcagagaggggtgacgccgtctgcacagaaagtgggtggcggccactcccatcctgcgaagaaaaaagttgcgataatccctacatcccgaatggggactactcaccactcagaattaaacacagaacaggcgacgagatcacatatcagtgtaggaacgggttttatccggcaaccagaggcaatacggccaagtgtaccagtacagggtggatccctgcccccaggtgtacactaaaaccttgcgattacccggacattaaacacggtggattgtaccatgaaaacatgcggcggccttacttccccgtggcagtcgggaagtattatagctattactgcgatgaacactttgaaaccccatcagggtcttactgggatcacatccactgtacccaagacggctggagtcccgccgtcccgtgtctgcgcaaatgctatttcccctatttagagaatggctataatcagaaccacgggagaaagttcgtccagggaaaatcaattgacgttgcatgtcacccaggatacgcgctgccgaaggctcagactacagttacttgcatggaaaatgggtggtcccctacccctcgctgcatccgtgtgatttttcagctgtag

SEQ ID NO: 2450 - DNA, 1350 bp, Artificial Sequence
  Description of Artificial Sequence: Synthetic coding sequence
atgcgccttctcgcaaagattatctgtctgatgctgtgggcaatctgtgtggcggaggactgcaatgaacttcctcctcgcagaaatacggagatactaaccggctcttggagtgatcagacctatccggagggaacgcaggcgatttataaatgtcggcctggatatagaagcttgggaaatgtgataatggtgtgccgcaagggcgagtgggtcgcccttaaccccctgcgcaaatgccagaaacgcccatgcggacaccccggtgacaccccctttggcacattcacgctgaccgggggaaacgtctttgaatatggcgtgaaagcggtctacacatgtaatgagggctaccagctgttaggcgaaatcaactatcgggaatgcgacacagatggctggacaaatgatatccctatttgcgaagtggtcaagtgtctccccgtgactgccccagagaatgggaagatcgtgtcttcagccatggagcctgacagagagtaccattttggacaggcggttcgtttcgtttgtaacagcgggtacaagatcgagggtgatgaggaaatgcattgtagcgacgacggattttggtctaaagagaaaccgaagtgtgtggaaatttcctgtaagtccccagacgtgatcaacggtagtccgataagccaaaagattatttacaaggaaaatgagaggttccaatacaagtgcaatatgggctacgaatatagcgaaagaggtgacgctgtgtgcaccgagtctggttggcggccccttccatcatgcgaggagaaatcatgtgataatccctatattcctaatggtgactattccccacttcgcatcaaacacaggaccggtgacgagatcacataccagtgtagaaatggtttttaccctgcgacaaggggtaacactgcgaagtgtacctcaaccgggtggatcccagccccgcggtgtactcttaagccatgtgactacccggatatcaaacatggaggtctataccacgagaacatgaggaggccatattttcccgttgccgtgggaaaatattatagctactactgtgacgagcattttgaaactcctagcggcagttactgggatcatattcactgtactcaagacgggtggtcccctgccgtgccgtgcctccgtaagtgctatttcccctacctagagaacggctacaatcagaatcacggcagaaaatttgtgcaaggcaaatcgattgacgtggcgtgccatccaggatacgctttacccaaggcgcaaaccacagtcacctgcatggagaacggctggtcacctacgccgcgatgcatcagggtgagctttacactatag

SEQ ID NO: 2451 - DNA, 573 bp, Artificial Sequence
  Description of Artificial Sequence: Synthetic coding sequence
atggctgcaggcgagctggagggtggtaagcccttgtctggcctcctgaatgcacttgctcaggatactttccacggctaccctggaatcacggaagagttattgcgtagtcaattatacccagaggtgcccccagaggagttcagaccgttccttgccaaaatgcggggaatcctgaaaagtatagccagcgccgacatggattttaaccagctcgaggcgtttctaacagcccagaccaaaaagcagggcggaatcacgtccgatcaggccgctgtgatatcaaaattctggaaaagccataagacgaagatccgtgaatccctgatgaatcagtcccgctggaactccggacttaggggactgagctggcgcgtagacggcaagtcacagagtcgccactctgcacaaattcacacccccgttgccataatcgagcttgaactaggaaagtacggacaggaaagtgaatttctttgtcttgagtttgatgaagtgaaggtgaatcaaattttgaaaaccctgagcgaggtcgaggagtcaatctcaaccctgatatctcaaccaaactag

SEQ ID NO: 2452 - DNA, 117 bp, Artificial Sequence
  Description of Artificial Sequence: Synthetic coding sequence
tgacaagagagcgagttcctgtgcctggaatttgatgaggtgaaggtgaatcagattctaaaaacactaagcgaggtagaggaatctattagtactctgatcagccaacccaactag

SEQ ID NO: 2453 - DNA, 99 bp, Artificial Sequence
  Description of Artificial Sequence: Synthetic coding sequence
taatgtttagaatttgacgaagttaaggtcaatcaaatcctgaagaccctatccgaggtggaggagtccatctcaacattaatctcgcagccaaattag

SEQ ID NO: 2454 - DNA, 117 bp, Artificial Sequence
  Description of Artificial Sequence: Synthetic coding sequence
taacaggagtcagaatttctttgcctcgaattcgacgaggtcaaagtaaatcaaattctcaaaactctgtccgaagtcgaggaatcgatcagcactctgatcagtcagcccaactag

SEQ ID NO: 2455 - DNA, 480 bp, Artificial Sequence
  Description of Artificial Sequence: Synthetic coding sequence
atggcagccggggagctcgaaggggggaagcccctgagtggactcttaaacgctctggcacaagacactttccacggctatcctggaataacggaagagctgctgaggtcccaattgtatcctgaagtgccacccgaggagttccgaccgttcctagctaaaatgcgggggatcctcaaaagcattgcctctgccgacatggactttaatcagctggaggcattcctgaccgcacagaccaagaagcagggcggcattacctcggaccaggctgctgtaattagtaagttttggaaaagtcataagactaaaatccgggagagtctcatgaatcagtcacgctggaacagcggtctgcggggcctatcatggcgcgtggatggaaagtctcaaagtagacacagcgctcagattcacacccccgtcgccattattgagttggagcttggtaagtacggtcaggtccactgcaatcaatag

SEQ ID NO: 2456 - DNA, 591 bp, Artificial Sequence
  Description of Artificial Sequence: Synthetic coding sequence
atgcgcctgcccctgctggtcagcgctggcgtgctgttggtggcactactgccctgtccaccctgccgcgctctgctttcacggggtcccgtgcccggtgcgcggcaggccccccagcacccccaaccactcgacttcttccagccaccccctcagtcagaacagcctcagcagccacaggcccgtccggttctgttaagaatgggcgaagagtacttcttgcgccttggaaatttaaacaaatctccggctgctcccctctccccagccagttccttgctagcaggggggtccggatctcgcccgagtcccgagcaggccacggcaaacttctttcgggtgctcttgcagcagctgcttctcccgcggagaagtctcgacagccccgcggccttagccgaaagaggggcaagaaatgcgcttggcggccaccaggaagctccggaacgagagcgcaggtcggaggagcccccaatttcactggatttgacctttcaccttctgcgggaggtgcttgagatggctcgggccgaacagctcgcccagcaagctcattctaacaggaagctgatggaaatcattgggaagtag

SEQ ID NO: 2457 - DNA, 4443 bp, Artificial Sequence
  Description of Artificial Sequence: Synthetic coding sequence
atgcaacggagcccactcgaaaaggcatctgttgtcagcaaactctttttttcttggaccaggcctattttaagaaagggctatcgccaacgcctggagttaagcgatatatatcaaattccatctgtggatagtgctgataatctgtccgagaagttggagagggagtgggacagggaactggcaagtaagaagaatcccaaactaattaacgctctccgaagatgctttttctggcggtttatgttctacggaatctttctctaccttggtgaagtgacaaaagctgtccagccgttactgctaggacggatcatcgcctcctacgatcccgacaacaaggaggaacggagcatagctatatatctggggattggcctttgccttttatttatcgttcgcaccctgctgcttcaccccgcaatattcggactgcaccatatcggaatgcagatgagaatagcgatgttctccttaatctataagaagaccttaaaactctcttcccgggtgctggataagattagtatcgggcagctggtatcactactgtccaataacctcaacaagttcgatgagggactcgctttggcccactttgtatggattgcccccctgcaagtggccctgctaatgggcctcatctgggaactcctgcaggcatccgcattctgtggccttggttttctgatcgttctcgctctgtttcaggcagggctggggcggatgatgatgaagtacagggatcagagggcagggaaaatcagtgaacgcctggtcatcacgtctgagatgatagagaacatccagagtgtaaaagcctactgctgggaagaagccatggaaaaaatgattgagaacctgcgccagacggagttgaaactgacacggaaggcagcttacgtaaggtattttaactcttcagcttttttcttttcaggattcttcgtcgtgttcctgagtgtacttccttatgccttgatcaagggcataatcctgaggaagatattcactaccatttccttttgtattgtgctcagaatggccgttacaagacagtttccttgggctgttcaaacgtggtatgactccctgggagccatcaataagattcaggacttcctccagaaacaggaatacaagaccctcgagtataatcttacaacgacagaggtcgttatggaaaacgtcacagcattttgggaggagggattcggcgagctgttcgagaaagcaaaacagaataataacaacagaaagacttccaatggcgacgacagtctgttcttttctaattttagcctgttgggcacaccagtacttaaggatatcaactttaagatagaacgggggcaattgctggcggtggctggaagcactggagctggaaaaacctcactcctgatggtcatcatgggagaattggaaccttccgaaggaaaaatcaaacactccggcagaatctccttttgctcccagttttcatggatcatgccgggaaccatcaaagagaacattatttttggggtgtcttatgacgagtataggtacaggtccgtgataaaggcttgtcaactggaggaggatatttccaagtttgcagagaaagacaacatcgtgttgggggaaggggggatcacgctgtccggcgggcaacgcgcccgaatttctctggcaagggcagtgtacaaggacgcggatttgtacttacttgacagtcccttcgggtacctcgatgtcttaaccgaaaaagaaattttcgagagctgtgtgtgcaagttgatggcaaataaaaccagaattttggtgacatccaaaatggaacacctgaaaaaagccgataagatcctgattctccatgagggatcctcgtatttttacgggaccttctcagagcttcagaaccttcagccggatttttcctccaagttaatgggctgtgattcgtttgaccagtttagcgcggagcggcggaattccatcctgacggagacactacatcgctttagtctggagggcgacgctccggtctcttggaccgaaaccaaaaagcagtccttcaagcagactggcgagttcggcgagaaaagaaagaacagcatcctcaatcctattaactctatcaggaaattttctattgtgcaaaaaacccctctccagatgaacggcatcgaggaggacagcgacgagcctcttgagaggcgcctgagcctcgtgccagattctgagcagggagaagctattttgcccaggataagtgtcatttctactggccctacattacaggctaggagaagacagagcgttttgaacctgatgacacacagcgtgaatcagggccagaatatccatagaaagaccactgcaagcacacgcaaagtgagcctggctccacaggcgaacctgacagaactggatatctacagtaggagactgagccaggaaacaggtctggaaattagcgaagagatcaatgaagaggatctgaaggaatgtttcttcgacgacatggaatcaatcccagcagtaaccacatggaacacataccttcgatatattaccgttcataaaagtctgatttttgtgttgatttggtgtctggtcatatttctggccgaagttgccgcttctctggttgtcctgtggctcctggggaatacccccttgcaggacaaagggaactctactcacagcaggaacaatagttatgccgtgatcattacaagcaccagctcctattacgtgttttatatctacgtcggagtggccgacactctcctggctatgggattttttcgtggcctgccactcgtgcataccctgatcacagttagtaagattttgcatcacaagatgctccattccgttctccaggcgcccatgtccacgctgaacaccctgaaggcagggggcatcttgaacagattctccaaagatatcgctattcttgatgatctgctacccctgactatttttgactttatccagttacttctgatcgttataggggccattgcagtagtggctgtgcttcaaccatatatcttcgttgcgactgtccctgtgatcgtcgcttttataatgctgcgggcctatttcctccagacatcccagcagctgaaacaacttgagtctgaagggaggagcccaatctttacgcacttggttaccagcctgaagggactctggaccttgcgtgccttcggtcggcagccctattttgagacgctgttccacaaggccctaaacctgcataccgcgaactggttcctctatctgagcaccttacggtggttccagatgagaatcgagatgattttcgtcatcttctttattgcagtgacctttatatctatcttaaccaccggcgagggcgaagggagagtgggtataatcttgaccctggctatgaatatcatgtccacactacagtgggccgtcaactcctcgattgacgtggactctctgatgcggtcagtatcgagggtctttaagtttatcgacatgcctactgaaggcaagccgactaagtctaccaaaccatacaagaacggacagctgtcaaaagtgatgatcatcgagaactcacacgttaagaaggatgatatatggccatctgggggccagatgacagtcaaagatctcactgccaagtatactgagggagggaatgctatcctggagaatatatccttttcaatcagccccgggcagcgagtgggcctcttaggtcgtacaggaagcggaaaaagtacattgctgagcgcctttctccggttactcaacactgagggtgagatacaaatcgacggcgtgtcatgggatagcataactcttcagcagtggcggaaggctttcggcgtgattcctcagaaggtttttatctttagtggcacattccggaagaaccttgacccttacgaacaatggtctgatcaagaaatttggaaggtggcggacgaagtggggctaaggagcgtgatcgaacagtttccagggaaattggacttcgttttagtggacggcgggtgtgtactgagccacggacacaagcagttaatgtgtctagccaggtccgtgctctcgaaagctaaaatccttctcctcgatgaacccagtgcccatctggaccctgtgacctaccagattattaggcgaactcttaagcaggccttcgccgactgcacagttatactgtgcgaacaccgcattgaagccatgctcgagtgccagcagttcctggtgatcgaggagaacaaggtccggcaatacgacagtatccagaagctgcttaacgaacgcagtttgtttaggcaggctatatcaccgtcggatcgggtgaaactgtttccccacagaaattcttcaaagtgtaagtctaagccccagattgctgccttgaaagaggaaaccgaggaagaggtccaggacacccgtctttag

SEQ ID NO: 2458 - DNA, 4317 bp, Artificial Sequence
  Description of Artificial Sequence: Synthetic coding sequence
atgcagagaagcccgctggagaaggcttcagttgtgtccaaattgttcttcagctggactcgacctatcctgcgaaaaggctaccggcagcggctcgaactgtcagatatctatcagattcccagtgtggactccgctgacaatttatcagagaagcttgaacgagagtgggaccgcgaattggcatcgaaaaagaaccctaaactgattaatgcacttcggagatgctttttttggcgattcatgttctacggcatcttcctctacctgggtgaagtgacgaaagccgtgcagccccttctgctgggccgcattattgccagttacgatccagacaataaggaggaaaggtccattgccatctatctcgggatcgggctgtgcctgttgtttattgttcgaacccttcttttgcaccctgccatattcggactgcaccacattggaatgcagatgaggatcgcaatgttctccctcatctataaaaaaggactggctctggcacacttcgtgtggatagcacccctgcaggtggccctcttgatgggcctgatctgggagctgctccaggcaagcgcgttttgcggactagggtttctgatcgtactcgctctgtttcaagcaggacttggcagaatgatgatgaagtatagagaccaacgcgctgggaagatctccgaaagattggtgatcacctctgagatgattgaaaatatacagagcgtcaaggcctattgttgggaagaggccatggagaaaatgatcgagaatctcaggcagaccgaactcaaattgacaagaaaagctgcttatgtaagatattttaactctagcgcctttttcttttccggttttttcgtggtatttttatcggtgttgccttatgcgctgataaagggaatcatactccgcaaaatattcacgactataagcttctgcatagtgttgaggatggccgtcacccgacagttcccgtgggctgtccagacatggtatgatagcttgggcgccataaacaaaattcaggactttttacaaaagcaggagtataaaaccctggagtacaatttaaccaccactgaggtcgtcatggaaaacgtgaccgccttctgggaggagggcttcggcgaattgttcgaaaaggccaagcaaaacaacaacaaccggaagaccagcaatggggacgattccctgttcttttcaaacttttctctgctgggcacgccagtgctcaaggatataaatttcaagatcgagcgcggacagctgttggccgtcgccggcagcaccggagcaggcaagacctctttgctgatggtcataatgggggagctcgaaccaagcgagggtaagatcaaacactctggacggatctcattctgcagccagttttcctggatcatgccaggcactatcaaggaaaacattatatttggtgtttcatacgatgagtacaggtaccgcagcgtcatcaaagcctgccaactcgaggaagacataagtaaattcgccgaaaaagataacatcgtgttaggggaaggtggaatcacattatctggggggcagcgtgcccggattagtctggcccgtgcagtctacaaggatgctgatctgtacctcctcgacagcccattcggatatctagatgttctgactgaaaaagagatctttgagtcctgtgtttgcaagctaatggctaacaagaccagaattttagtgacaagcaagatggaacaccttaagaaagcggataaaatcctgatcctgcacgagggcagtagctatttttatggcacattttccgagctacagaacctccaacctgattttagtagtaaattaatgggttgtgatagctttgaccaattctctgctgaaaggcgaaatagcattcttacagagactttgcaccgtttctctctcgagggagacgctcccgtttcctggaccgagaccaaaaagcagtcctttaagcagactggagagtttggcgagaagcggaagaattcaatactgaacccgatcaactcaattcgcaagttctccattgtgcaaaaaacgccactccaaatgaacggaattgaggaagactctgatgagcccctggaaagaagactgtccctagtgcctgattctgaacagggggaggccatcctgccccgcattagcgtaatttcaactggtccaactctgcaggcccggaggcgtcagtctgttctgaatctgatgactcactccgtaaaccaaggccaaaatattcataggaagaccacagcctccacacgtaaggtgtcgctggccccgcaagccaatctaacagagctagacatctattccagaagattatcacaggagacagggctggagatatcagaagagatcaatgaggaagacctgaaggagtgtttctttgacgatatggaatctattcccgctgtgacaacgtggaatacatatttacggtacataacggttcacaaatcattaatctttgttctgatctggtgtctggtgattttccttgcagaagtggccgcgagcctggtggttctgtggctcctgggaaataccccattacaggacaaaggtaattccacccacagtaggaacaacagttacgccgttatcataacatctacttcatcctattatgttttctacatatatgtgggggtcgctgacacattgctggctatgggcttcttcaggggactgcctctggtacacaccctgattacagtcagtaagatcctccaccacaagatgctacacagcgtactccaggcgccaatgtctacactcaatacactgaaggcgggcggtatactaaatcgcttcagcaaggatatcgctatactggacgatcttctcccgctcacaatcttcgattttatacaactattactgatagtcatcggcgccatcgctgtggttgccgtactgcagccctacattttcgtggccacagtgccggtgattgtggcctttattatgcttcgcgcatatttccttcagacatcacagcagttaaagcaactggagagcgagggccggtcccccatctttactcacctggtaacttcgctcaaggggctctggactctccgcgcattcggccgccagccatatttcgagaccctatttcacaaggcactaaacctgcacacggccaactggttcctgtacctaagtaccctcaggtggttccagatgcggatagagatgatttttgttatctttttcatcgccgtgaccttcatttccatcctgaccacaggagagggcgaagggagagtggggatcatcctgaccctggctatgaacattatgtccacactgcagtgggccgtaaattcttccattgacgttgactctttaatgcgctccgtcagtcgggtgttcaagttcatagatatgcctaccgagggaaaaccgacaaaatccaccaaaccatacaaaaacgggcagctgagcaaagttatgatcattgagaattcacacgtgaaaaaggatgacatctggcctagtggcggtcagatgacagtgaaggaccttaccgccaagtacactgaagggggcaacgccattctggagaatatttccttttctatctctcctgggcaacgggtgggccttttggggcgtacaggaagtgggaagtctactctcttatctgcctttctgcgcctcctcaatactgaaggagagatccagatcgacggggtgagctgggacagcatcaccctgcagcagtggaggaaagccttcggtgtcatacctcaaaaagtcttcatattcagcgggacttttcgtaagaatctagatccctacgagcagtggagtgaccaggagatctggaaggttgctgacgaagtgggcctaaggtcagttatcgagcagttccccggtaagttagacttcgttctggtagacggaggttgtgttttgtctcacggacataagcagctgatgtgcttggctcgctcagtgctcagcaaagcaaaaattcttctcttggacgagccttccgcccacctcgacccagtcacatatcagatcatccgtaggacacttaagcaggcgtttgccgactgtacagtgatcttgtgcgagcacagaatcgaggccatgctcgagtgccaacagtttctcgttattgaggagaataaggtgcggcagtatgactcaattcagaagttgctgaacgagaggtcactgttcaggcaggctatctccccttccgaccgtgtgaagctgttcccacatcggaactccagcaagtgtaagagcaagccacaaatcgctgctttgaagtag

SEQ ID NO: 2459 - DNA, 4260 bp, Artificial Sequence
  Description of Artificial Sequence: Synthetic coding sequence
atgcagcgaagtccgctggaaaaggcaagtgtcgtgagtaagctctttttctcttggacaagacccattttaaggaagggatatagacagagattggaactgtctgacatctaccagattccctcagttgatagcgcggataacctctcagaaaaactcgaaagggagtgggaccgggaactggcctccaaaaagaaccccaagttgatcaacgccctccggagatgctttttctggcggttcatgttttacggcatctttctctatctaggcgaagtcacaaaggctgtgcagccactactgctcggcaggatcattgcatcttacgaccctgataataaggaagagcgctccatagccatctatcttggtattggcctgtgcttgctcttcatcgtgcgcacgctccttttacatccggccattttcggactccatcacattggaatgcaaatgcgcatcgcaatgttctctttgatttacaagaagacacttaaactgagcagccgcgtgctcgacaaaatcagcattgggcagctcgtatccctgttgtctaataatctgaacaagtttgatgaaggcttagctctggcccactttgtctggatcgctccattgcaggtcgctctccttatgggcttaatttgggaactgcttcaagcctccgccttttgtggactgggcttcctgatcgttctggccctgtttcaggctggactaggcaggatgatgatgaaatatagagatcagcgggctggcaaaatctccgaacgcctcgtcatcaccagcgaaatgatcgagaatattcaatctgtgaaggcatattgttgggaggaagccatggagaagatgatcgaaaatctcagacagactgagctgaagctgacacgaaaggctgcctacgtgcggtatttcaattcatccgccttctttttttctggcttctttgtcgtgttcctcagtgtgctgccttatgccctgattaagggaattatattgaggaaaatcttcacaactattagtttctgtattgtcctccgaatggctgtaacaagacagtttccatgggcggtacaaacctggtatgattcacttggggcgatcaacaaaattcaagactttttgcaaaagcaggaatataaaaccctggagtataacttaacgaccactgaggtagtcatggagaacgtcaccgccttctgggaagagacatcgctactgatggtaattatgggggaactagagccctctgagggaaagattaaacattctggacgcattagcttttgcagccagttctcctggatcatgccaggtaccattaaggagaatattatttttggggtatcctacgatgaatatcgttatcgtagcgttatcaaggcctgccagctcgaggaggacataagtaaattcgcggagaaggacaacatagtgcttggggagggaggaatcactctgagtggggggcagagagcacggatcagtctggcaagagccgtttataaagatgcggatctctacctgctggactcaccatttggatatctggacgtgctcaccgagaaggagatcttcgagtcttgcgtttgcaagctgatggctaataagaccagaatcctagtgactagtaagatggagcatctgaaaaaggcggacaaaattctgattctccacgagggctccagctatttctacggaaccttctccgaactgcagaatctccaacccgatttttcttctaagctgatgggctgcgatagcttcgatcagttttctgcagaacgaagaaacagcattttgaccgaaacgctacatcggttttcattggagggagatgcccccgtatcatggactgagacaaagaagcagtcctttaaacagacaggtgaatttggggaaaagagaaagaactccatcctaaatccaatcaactccataagaaaattcagtattgtgcaaaaaactcccctgcaaatgaatgggatagaggaggatagtgatgagccactggagcgccgactgtccctcgtgccggacagtgagcagggcgaagcaatcctgcccaggatctctgtcatttctaccgggcctacgctccaagcacgtcgcagacagtcggtgcttaatctcatgacgcattccgtgaaccaagggcaaaacattcaccgaaaaacaacggcctcaacaaggaaggtctctctggctcctcaggctaacttgactgaattagacatctattctcgtcgcttgagtcaggagactggcctcgaaatctctgaggagattaatgaagaggacctaaaagaatgtttctttgacgacatggaaagtatccctgctgtgaccacatggaatacctacctcaggtacattaccgtgcacaagtcgcttatttttgtgcttatctggtgtctcgtgatattcctggctgaggtcgcagccagtctggtggttctttggctacttgggaacactccgctccaggataaagggaattcaacgcattctaggaacaactcgtacgctgtgatcatcacatctacttccagttattacgtgttctatatttatgtgggtgtggccgatactctgctggccatgggattcttccgaggcctccccttggtccacaccctgatcacagtctcaaagattctccatcataagatgttgcatagcgtactgcaggcgcctatgtctacactaaataccctcaaagcaggaggtatactgaaccgtttctctaaggatattgcaatcctcgacgacttactgccactgaccatcttcgattttatccagttgttgctgatcgttattggcgccatcgctgtcgtggcggtcctgcaaccttacatcttcgtggccactgtacccgtgatcgtcgcctttatcatgttaagagcctactttctacagactagtcaacagctaaaacagctcgagtctgagggtcgatctcccatttttacccatttggtgacatctctgaaaggcctctggacactacgggcgttcggcagacagccttactttgaaactttatttcataaagcattgaaccttcacaccgctaactggtttctgtatttatcgaccttgcgttggtttcagatgcggattgagatgattttcgtgatattctttatcgcagtgacattcatttcgattcttacgaccggagaaggggaaggcagggtggggatcatcctaaccctggcaatgaacatcatgagcaccctgcagtgggccgtgaactcaagcatagacgtcgactctcttatgaggtctgttagccgcgtgtttaagttcatcgacatgcccaccgaaggaaagcctacaaaatctaccaaaccctataagaacggtcaactgtcaaaagtcatgattatcgagaattcacatgtgaaaaaggacgatatctggccctcaggcggccagatgacagttaaggatctgacagccaagtatacagaaggggggaatgcaatcctggaaaacattagcttctcaattagtccggggcagcgcgtaggcctcctcggacgcacaggaagtggaaagagtaccctcctctccgccttcctgcgcttgctcaataccgaaggggagattcagatcgacggggtgagttgggacagtattaccctacagcagtggcgcaaggcttttggtgtgattccacagaaagtctttatcttctcggggacctttcggaaaaatcttgacccttacgaacaatggtcagatcaggagatttggaaggtcgcagacgaggtgggcctccggagcgtgatcgagcagtttccaggcaaactggactttgtcctggtggacggggggtgcgtgctgtcccacggacataaacaactgatgtgcctggcaaggagcgtgttgtcaaaagctaaaattcttctcttagacgagccgtctgcgcacctcgacccggtaacataccaaataattcggaggacactcaaacaggctttcgctgactgcacagttattctgtgcgagcataggattgaggcaatgttagaatgtcagcagttcctggtcatcgaagagaacaaggtcagacagtatgactctattcagaaactattaaatgaacggtctttgttccgccaggctatctctccgtctgacagggtgaagctgttcccacacaggaatagttctaaatgcaagagcaagccacagatagcggctctcaaagaagaaaccgaggaggaggtgcaggatactcggctctag

SEQ ID NO: 2460 - DNA, 573 bp, Artificial Sequence
  Description of Artificial Sequence: Synthetic coding sequence
taaaagggactgtggaccttgcgcgcatttggaagacagccttattttgagaccctgttccataaggcgcttaacctgcataccgcgaattggttcctgtacctctcaactctgaggtggttccaaatgcggatcgagatgatttttgtgatcttttttatcgcggttacattcatcagcatactaaccacaggggaaggcgagggcagggttgggatcattctcactttggccatgaacatcatgtccaccttgcagtgggccgttaatagtagcatcgatgttgactcgttgatgcgaagtgtgtcccgcgtgttcaagtttattgatatgccaaccgaaggcaagccaaccaagtcgaccaaaccgtataagaacggtcaactctcaaaagttatgattattgagaactcgcacgtcaaaaaggatgatatttggcccagcgggggccagatgaccgtgaaggacctgactgccaaatacacggagggcggaaatgccatcctggagaacatctccttttctatctcccccgggcagagagtgcgcttcgagcattgtctgctgtgttag

SEQ ID NO: 2461 - DNA, 1203 bp, Artificial Sequence
  Description of Artificial Sequence: Synthetic coding sequence
atgatccgcaactggttaaccattttcatactgttcccactgaagttggtggaaaagtgcgaatcctccgtgtcgctgacagtgccccccgtcgtgaagctggagaacggtagcagtactaacgtgtccctgaccctgcgaccccccctcaacgccacactcgttataaccttcgagataaccttccggtctaaaaacatcacaatcttggagctcccagacgaagtggttgttccccccggcgtgacaaatagctctttccaggtcacaagccagaatgttggacagctgacggtatatttacatgggaaccactccaaccagaccggcccgcggataagatttctcgtgatccgatcgtccgcgatctcaattatcaatcaggtaatagggtggatctactttgtcgcgtggtcaataagcttctacccacaggtgattatgaattggaggagaaaaagcgtgattggactgtcattcgactttgtggccttaaacctgacgggatttgttgcctattccgtgtttaatataggactgctctgggtgccctatatcaaggagcagttcctgttgaagtatcccaacggggtgaaccccgtcaactccaacgacgtcttcttctctctgcatgcagttgtcctaacgctgattatcatcgtgcaatgttgcttgtatgagagaggagggcagagggtcagctggcctgcgataggttttctggtgctggcgtggctgtttgctttcgtaacaatgatcgtggctgccgtcggcgtcactacttggctgcaattccttttttgctttagctatatcaaacttgcagtgacactggtaaaatacttcccacaggcctatatgaacttctactacaaaagtaccgagggctggagcattgggaatgtgcttctcgacttcaccggcgggtctttttctttactccagatgtttctgcagtcttataacaatgaccagtggactcttatttttggcgacccaacgaagtttggccttggggtgttcagcattgtgttcgatgtggtgttcttcattcagcatttttgcttgtatagaaagaggcccggacttcaggccgcccggaccggctccggttctaggctcaggcaggattgggcacccagtttacagcccaaagctctgccacagaccacaagcgtgtccgcatccagcttgaagggctag

SEQ ID NO: 2462 - DNA, 1104 bp, Artificial Sequence
  Description of Artificial Sequence: Synthetic coding sequence
atgattagaaattggttgacaatattcatcttattcccgctcaagttagtggaaaagtgtgaaagttctgtgtccttaactgtgcctcctgtggtaaagttagaaaatggctctagcaccaacgtgtctctcactctgcgacctcccttgaatgctacgctggttattacttttgagattaccttcagaagtaaaaacattacaatcctagaattgcccgatgaggttgtagtcccacccggtgtgactaacagcagctttcaggttaccagccagaacgtgggacagctgacggtgtatcttcacggaaatcacagcaaccagacaggcccgaggattcgctttctggttattaggagtagtgccatttcaatcattaaccaagtaatcggatggatctattttgtggcctggtcaatcagcttctaccctcaggtcataatgaattggagacggaagtctgttatcggactctccttcgactttgtcgcgctcaacctcaccgggtttgtggcttactcggttttcaacataggcttgctatgggtgccctacataaaagagcagtttttattaaagtaccccaacggcgtgaaccctgtgaacagtaacgacgtgttcttctcacttcacgccgttgtgcttaccctgatcattattgtccagtgttgcctttatgaaagggggggacaacgcgtgtcatggccagcgattggcttcctcgtgctcgcctggctctttgcctttgtgaccatgatcgtggcagccgtgggagttacgacatggctgcagtttctgttctgcttttcttacattaaactggccgtgaccctggtcaaatatttcccccaggcgtacatgaatttttactataagtcaacagagggatggagtataggcaacgtgctattagactttacgggtggcagcttttctttgctgcagatgttccttcagagctacaataacgaccagtggaccctaatattcggtgatcccaccaaatttggcctgggggtcttctcgatcgtcttcgacgtagtgtttttcattcagcacttctgtctgtataggaaaaggccagggtacgatcaattaaactag

SEQ ID NO: 2463 - DNA, 663 bp, Artificial Sequence
  Description of Artificial Sequence: Synthetic coding sequence
atgaactggaggagaaaatccgtcattgggttgtccttcgattttgtagctttgaatctcactgggtttgtcgcttattcagttttcaatattggtctactatgggtgccttatattaaggaacagtttctgctcaaatatcccaacggggttaatccagtgaactcaaacgacgtcttcttttcgctgcacgcagttgttctcacactgataattatcgtgcaatgttgcctgtatgagcgaggggggcaacgtgttagctggccggcaattggcttcctggttcttgcttggctatttgccttcgtcaccatgattgttgcggcagtgggggtgacgacatggttgcagttcctgttttgcttcagttacataaaactcgctgtaacgcttgtgaaatatttcccacaagcgtatatgaacttctactataagagcactgaaggctggtctattggcaacgtgcttctggattttaccggtggatccttttccctgctgcagatgttcctgcagtcctataataacgaccagtggactttgatctttggtgaccccacaaagtttgggctaggagtgttctccattgtgtttgacgtcgttttcttcatacagcatttttgtctttatcggaaaagaccaggatacgaccaactgaactag

SEQ ID NO: 2464 - DNA, 879 bp, Artificial Sequence
  Description of Artificial Sequence: Synthetic coding sequence
atgtgtcctcgcatcagatttctggtgattagatcatccgctattagcataattaatcaggtgatcggctggatttactttgtggcctggtctataagcttttaccctcaagtcattatgaactggcgaagaaagtccgtcattggcctgtctttcgattttgtagccctcaatttaaccggcttcgtggcctacagcgtcttcaacataggattgctctgggtgccctatattaaagagcagttcttgctgaaatatcccaatggtgtgaaccctgttaacagcaacgacgtgtttttcagcttacatgctgtggtgctgacactgattattatcgtccaatgctgtttgtatgagcggggcggacagcgcgtctcctggccagctatcggttttctcgtgctggcctggctcttcgcatttgtaacgatgattgtggctgcagttggcgtcacaacgtggctccagttcctgttttgcttttcttatatcaagctggccgtaacactagtcaaatacttccctcaggcgtatatgaacttctactacaagagcacagaaggttggagcattggcaatgtgctgctagatttcacgggcggcagttttagtttgcttcagatgtttttgcagtcttacaacaatgatcagtggaccttgatattcggcgatcccaccaagttcggcctgggtgtttttagtattgttttcgatgtagtcttttttatacagcacttctgcctgtacaggaagcgcccaggcctccaggccgctaggaccggcagcggaagcaggctaagacaggattgggcgccttctctgcagcctaaggccttaccacagaccacctcagtgtctgctagctcccttaagggctag

SEQ ID NO: 2465 - DNA, 228 bp, Artificial Sequence
  Description of Artificial Sequence: Synthetic coding sequence
atgatccgaaactggctgaccattttcatactctttcctcttaagctcgtggagaaatgtgagagctctgtgtcacttaccgttccgccagtggtaaaattagaaaatgggtcctccaccaacgtgagcctgaccttacgaccccccctcaacgctaccttagtgatcacatttgagattacattcaggtcaaaaaatatcacaatcttggagctgccagacgaatag

SEQ ID NO: 2466 - DNA, 204 bp, Artificial Sequence
  Description of Artificial Sequence: Synthetic coding sequence
atgcggatccattaccttttgttcgccctgttgtttttgttcttggtccccgtgcccggacacggcggaataattaataccctgcagaagtactactgccgtgtgaggggtggacgttgtgcagtcttgtcttgcctgcctaaggaagaacagatcggaaaatgcagcacccgaggtaggaagtgttgtcggcgaaagaagtag

SEQ ID NO: 2467 - DNA, 204 bp, Artificial Sequence
  Description of Artificial Sequence: Synthetic coding sequence
atgagaattcactaccttctattcgccttgctctttttattcctggtgccagtaccgggacatggtgggattatcaataccctgcagaaatactactgccgggtgagaggagggcgctgcgccgtgttaagttgtctgcccaaagaggagcagattggtaagtgttccaccaggggccggaaatgttgtcggaggaagaagtag

SEQ ID NO: 2468 - DNA, 195 bp, Artificial Sequence
  Description of Artificial Sequence: Synthetic coding sequence
atgcgcgtgctttatctgctattctcatttctgtttatcttcttaatgccgctcccgggggtctttggcgggataggcgaccccgtaacctgcttgaagtccggcgccatctgtcaccctgttttctgtcctcgccgctataagcagatcggtacgtgtgggttacccgggacaaagtgttgcaagaagccctag

SEQ ID NO: 2469 - DNA, 195 bp, Artificial Sequence
  Description of Artificial Sequence: Synthetic coding sequence
atgcgtgtactttatctcctgttttcctttctcttcatcttcctgatgcccctaccaggagtgtttggcgggattggcgatcccgttacttgtctgaagagcggagctatctgtcacccagtgttctgccctaggaggtataagcagattggaacgtgtggtctgcccgggaccaagtgttgcaagaaaccctag

SEQ ID NO: 2470 - DNA, 849 bp, Artificial Sequence
  Description of Artificial Sequence: Synthetic coding sequence
atgagaggcatgaagctgctcggcgcgctgctggcactggctgcattgttacagggggcagtgtccttaaaaattgccgcttttaacattcaaacattcggagaaaccaagatgtctaacgctacactggtttcatatattgtgcagatcttgagccggtacgacattgccctggtgcaagaggtgcgcgactcccatctcacggcggtgggcaaactgctggacaacctgaaccaggacgcccccgacacctaccattatgtcgtgtccgaacccctcggaaggaattcatataaggagcgctacctctttgtgtaccgcccggaccaggtatccgcggtggattcctactactacgacgatggctgtgaaccttgcggcaacgatacttttaatagagagcccgctatcgtcagatttttctctcgtttcacggaggtgcgtgagttcgcgattgttccattacatgccgccccgggagacgccgtggctgaaatcgacgccctttacgacgtgtatctggacgtccaagaaaagtggggcctggaggacgtcatgctaatgggagacttcaacgctggatgctcctatgtgcgtccatcccaatggtcatccatccgactgtggaccagtcccacatttcagtggcttatcccagattcggctgatacgacagccacccccacacattgtgcctacgaccgcatagtggtggcgggaatgctcctgaggggcgcagtggtaccggatagtgctctacccttcaattttcaggctgcctacggcctgtctgaccagcttgcccaagccatcagcgatcactaccctgtcgaagtcatgcttaaatag

SEQ ID NO: 2471 - DNA, 849 bp, Artificial Sequence
  Description of Artificial Sequence: Synthetic coding sequence
atgaggggaatgaagttgctcggagcgctcctggccctggctgccctacttcagggagctgtgtcgttgaaaatagccgccttcaatattcagactttcggggagacaaaaatgtccaacgctaccctcgtgtcctatatcgtgcaaattctgagcaggtacgatattgcgttggtgcaggaggtgcgggatagccacctaactgccgtgggcaagctactggacaatctgaatcaggacgcgccggacacttaccattatgtggtgtccgagcccttgggcaggaatagttataaggagcgctatctgttcgtttacaggccagaccaggtgagcgccgtcgactcctattactacgacgacggctgcgaaccttgcgggaatgacacttttaatcgtgagcccgccattgtccggtttttctcacggtttaccgaagtgcgagagttcgcaatcgttccactgcacgccgcgccaggagatgctgtggccgagattgacgcactctatgacgtgtacctcgacgtgcaagaaaagtggggcctagaggatgttatgttgatgggagatttcaacgccggctgcagttacgtacggccgtctcagtggtcctctattcgcctctggaccagccctacatttcagtggttgattcccgattctgccgacaccacagctactcctacccattgcgcatacgacagaattgttgtcgccgggatgctgctgcggggtgctgtggtgccagacagcgccttgccctttaacttccaggcagcttacgggctcagtgaccagctggctcaggccatctctgaccactatcccgttgaagttatgttaaaatag

SEQ ID NO: 2472 - DNA, 564 bp, Artificial Sequence
  Description of Artificial Sequence: Synthetic coding sequence
atgcaccaaacacccatcactacctggagtgtgtctcattgggatggcacggctattagatctgcaacatgtagctgtacgggcctgacacgatgcctgagatggacagccacgaccaccatgatggcagcctcccccgccggcactaccccttccaccgagtcacagcccctgagcggcagctcccctggttctcaagacgtaatgctcatgggcgacttcaacgctggatgtagctacgtacgaccatcccaatggtcttcaattagactgtggaccagtcccacctttcagtggcttattcccgactccgccgatactacagccacaccaacacattgtgcctacgatagaatcgtcgtagctggcatgcttctgcgcggggctgtagtccccgattccgcactgccctttaacttccaagccgcttatgggttgtccgaccaattattctctgtgcacacatgttccggtgcagggctcggcgaaagacacgggttgccagcaagcgcggccttgccctccaatacctgtcgtgcaggcacgcacagagtcagcacgtag

SEQ ID NO: 2473 - DNA, 6243 bp, Artificial Sequence
  Description of Artificial Sequence: Synthetic coding sequence
atgctcagagtctttatcttgtacgctgaaaacgtgcatacacccgatactgatattagtgacgcttattgctccgccgtgtttgccggcgtcaagaaacgaacgaaagttataaaaaacagcgttaatcctgtgtggaacgaaggattcgagtgggacttgaagggaattcccctggatcagggttctgaactccacgtggtggtgaaagaccatgagactatgggacggaaccgctttttgggggaggcaaaggtcccactcagagaagtcctagctaccccctctttatctgcaagctttaacgccccactgctagatacgaagaaacagcccacaggggcttctctcgtgctacaggtttcgtataccccactgccaggcgccgtccctctgttcccccctccaactcctctggaaccttcacctacactccccgacctggatgtggtagccgacaccggcggcgaggaagacacagaagaccaggggctgaccggcgacgaggccgagccatttcttgaccaaagcggaggccctggtgctccgacaactcccagaaagcttccctccagacctccacctcactaccccggtatcaagaggaagcggtccgcaccaacatctcgaaagctgttgagcgacaaaccacaggattttcaaattagagtgcaggtcattgagggccggcagctgcccggggtcaacatcaagcctgtcgtgaaagtgaccgctgctgggcagactaaacgaaccaggatccacaaaggaaatagccccctttttaacgagaccctcttttttaatctttttgactcgcctggcgagctgttcgacgaacccatatttattacggttgtggatagcaggtccttgcgtacagatgcattgttaggtgaattccgaatggacgtcggaacaatatatcgcgaaccgcgtcacgcctatcttagaaagtggttgctgttgtcagatcccgatgatttctccgcaggcgctcgtggatacctcaagacatcactgtgtgtcctcggaccaggggatgaagctcccttggaaaggaaagatccttctgaggacaaggaggacatcgagtccaacttgctgaggccaacaggtgttgcacttagaggcgctcatttctgcttgaaggtcttccgggctgaggatctgccacaaatggacgatgctgtcatggacaatgtaaaacagattttcggcttcgagagtaacaaaaagaatctggtggatccatttgtcgaggtgtcctttgctggcaagatgctgtgctctaagattctggagaaaaccgctaatccacagtggaatcagaacatcaccctaccggccatgttcccatccatgtgcgaaaagatgcgaatcaggatcattgattgggatcggttaacgcataacgacatcgttgcaactacatatttgagtatgtccaagataagtgcccccggcggagaaattgaggaagagccagcgggggccgtcaaaccttctaaggcttccgacctggacgactacttaggttttctgcctactttcggcccatgctatattaacctttatggcagcccgcgcgaatttaccggcttccccgatccatacactgagctgaacaccggcaagggcgagggcgttgcttataggggcagattactcttgagtctagaaactaagctggtggagcattcagagcagaaggttgaggacctaccagcagatgatattctcagagtggagaagtacctcagacggcgtaaatatagcctattcgccgccttttactcagcaaccatgctgcaagacgtggatgacgctatccagttcgaagtttcgattggtaactacggaaataagtttgacatgacctgcttgccattggcctctacaactcagtatagtcgggcggttttcgatggctgccactactactacttaccttggggaaatgtgaaaccagtggtagtcctatctagctattgggaggacatcagtcatagaatagagactcagaaccaactgctgggtattgcggatagactcgaggcaggcctggagcaggttcacctagctcttaaggcacaatgtagtactgaagatgtggacagtcttgtggcccagctgaccgacgaattaatcgccggatgctctcagcccctaggcgacattcatgagacgccgagcgccacccatctagaccagtatttgtaccaacttaggacgcatcacttgtcccagatcaccgaggctgccctggcattgaagttagggcactcagagctgccagctgccctggagcaggctgaggattggcttctccgccttagggctctggccgaggagccccagaacagcctccccgacatagtgatctggatgcttcagggtgacaagagggtagcttatcagcgggtgcccgctcaccaagtgctgttttcacgccgaggggccaattattgtgggaagaattgtggcaagctgcagactatcttcctgaaatatccgatggagaaagtgcctggcgctagaatgcctgtgcagatcagggtgaagctctggtttggtctaagcgtcgatgaaaaggagttcaatcagttcgccgaagggaagctgtcagtgttcgccgagacctacgagaacgaaacaaagctcgccctcgtcggcaactggggaaccacaggtctgacataccccaagttctctgacgtcaccgggaagattaaactgccaaaggatagtttcaggccttccgccggctggacctgggccggtgattggttcgtgtgcccagaaaagacccttctccacgatatggatgcgggacatttgtctttcgtcgaagaggtgttcgagaaccagaccaggttgcctggtggtcagtggatctacatgagtgacaattataccgatgtcaacggcgaaaaggttcttccgaaggacgatatagagtgtccactcggatggaagtgggaggacgaggagtggtcgaccgatctgaatagggctgttgatgagcagggttgggagtacagtatcaccatccctcccgagcgaaaacccaagcactgggtcccagcggaaaaaatgtattacactcatagacggcggagatgggtcagactccggcgaagagatctgagccagatggaggccttgaaaagacacaggcaggccgaagcagaaggcgaaggctgggagtacgcctcgctcttcggatggaaatttcacctggagtaccgtaagactgacgccttccgacgtcgccgatggagacggaggatggagcctctggaaaagactggccctgccgccgtcttcgctctcgagggcgcactgggaggagtaatggatgacaagagcgaggattcaatgtctgtcagtaccctcagttttggagtgaaccgaccaactatctcttgcattttcgattatggaaaccgctatcaccttagatgctacatgtaccaggccagggatctggccgccatggataaagacagcttcagcgacccttacgctatcgtgtcattcctccatcagtctcagaaaactgtggttgtgaagaacacactgaatccgacatgggaccaaactctgatcttctacgagattgaaatcttcggcgagccagcaaccgtggcagagcagccaccctcgattgtggttgagctctacgaccatgacacatacggagcggatgagttcatgggcaggtgcatttgccaaccttccttggagcgaatgccgcgattggcttggtttcctctgacaagagggagtcagccctcaggtgaactcctggcttcattcgagttaattcaacgggagaagccagccattcatcatattcccggattcgaggttcaagaaacctcaaggatcttggacgaatctgaggacacggatctaccttatccaccacctcaaagggaagccaatatttatatggtgcctcagaatattaagccggccctgcagaggactgcgatcgaaattctcgcgtggggcctgcgcaacatgaagtcataccagctcgcaaatattagtagccctagcttggtggtcgagtgcggcggacagaccgtccaatcttgtgtaatccgcaacctacgaaaaaaccctaactttgatatttgtacgctatttatggaagttatgcttcccagagaagaactttactgcccccctatcactgtgaaagtcatagacaatcgtcagttcggacgtagacccgtggtaggccagtgcaccatccggtcactcgagagcttcctatgtgacccctatagcgccgaatccccatccccccagggggggcccgacgatgtgagtctgctcagcccaggtgaggacgtgctcatcgatattgacgataaagagccccttattcccatccaggaggaggagttcatcgattggtggtcgaaatttttcgcttctatcggcgagcgcgaaaagtgcggaagttacctcgagaaggatttcgacacactgaaagtgtatgatacacagttagagaatgtagaagcatttgaaggcttaagcgacttttgcaataccttcaagctgtaccgcggcaaaacacaggaggaaacggaagacccatccgtgatcggcgaattcaaaggcttgttcaagatctaccctttgcccgaagatcctgccataccaatgcctcctagacagttccaccaactcgccgctcagggcccccaggaatgtctagtgaggatatatatcgtccgggcatttgggctgcagcctaaagacccaaacgggaagtgcgacccatatatcaagatctctatcggaaagaaaagtgtctcagaccaggacaactacataccctgcactcttgaacccgtattcgggaagatgttcgaacttacctgcaccttgcccctggaaaaggacctgaaaataactctgtacgactacgacctgctctccaaagatgaaaaaattggcgagaccgtagttgaccttgaaaaccggctgttgagcaaattcggagctagatgcggcctgccccaaacctactgtgtgtccggtccgaaccagtggcgcgaccagctaaggccgagtcaactgttgcatctcttctgccagcagcaccgtgtgaaagcacctgtgtaccgaactgaccgcgtcatgttccaggataaggaatacagcatcgaggaaatcgaggcaggccggatccccaacccacaccttggcccagtggaagaacggctcgctttgcacgtgttgcagcagcaggggttggtaccagagcacgttgagtcccgcccactatacagtcccctgcaaccggatattgagcagggcaagttgcagatgtgggtggatttgttccccaaggcactgggccggcccggccctcccttcaacattacgccgcggagggcgagacggttctttctccggtgcataatttggaacacgagggacgtgatcctggatgatttgtcactcaccggtgaaaagatgtccgacatttatgtaaagggatggatgatcgggttcgaggagcataaacaaaagactgatgtgcattatagatccctgggcggagagggcaacttcaactggcgctttatttttccattcgactatctgccagccgaacaggtttgcactatcgctaagaaggacgcattttggcgtttggacaagacggagagtaaaatccccgcaagagtggtgtttcaaatctgggacaatgacaaattcagctttgatgattttctagggtcactccagctcgacctaaaccggatgcctaaacctgctaaaaccgccaaaaagtgctctctggaccagctggatgacgctttccatcctgagtggttcgtcagcctgttcgagcagaaaactgtgaaagggtggtggccctgtgtggctgaagagggcgagaagaaaatacttgctggaaagctggaaatgactctcgaaatcgtagccgagagtgagcacgaggaacgccctgccggccaagggagggacgaacctaacatgaatcccaaactggaggacccacgacgaccggacacgtcatttctctggtttacatctccttataagaccatgaagttcatcctatggcgacgctttaggtgggcgatcatcctcttcataattctattcatactgctgcttttcctggcgatctttatttatgcatttcccaactatgctgcaatgaaactggtcaaaccctttagctag

SEQ ID NO: 2474 - DNA, 6246 bp, Artificial Sequence
  Description of Artificial Sequence: Synthetic coding sequence
atgctttgctgcctgcttgtacgggcttcaaacctgcctagtgctaaaaaagatcgccgcagcgatccagtggctagtctcacattcagaggcgtgaagaagaggacaaaggttataaagaattctgtgaaccctgtctggaatgaaggtttcgaatgggacctgaaggggattccattagaccagggatctgagcttcatgtcgtggtcaaagaccacgagaccatgggacggaataggtttctcggtgaggccaaagtgcccttgcgcgaggtcctggctaccccttccctgtctgcttcatttaacgcgcctcttctggatacaaaaaagcagcccacgggagcttctctagtgctgcaggttagctacaccccgctgcctggcgctgtgcccctgttccctcctcctacacccctggaacccagcccaaccttgcctgacctcgacgtcgtcgcagacaccggtggcgaggaagataccgaggatcagggccttacaggagacgaggccgagccgttcctcgatcagtctggagggccaggcgcgcccacaactcctaggaaactgcctagcagacccccgccacattaccccgggattaagcgcaaacgcagcgcaccaacgtcacggaagttgctttctgacaagccccaggacttccagattcgggtgcaggtaattgagggtcgtcagctgcccggcgtcaacataaagcctgtcgtcaaagtaacagcggctggtcaaacaaaaaggaccagaatacacaagggcaactcaccgctgttcaatgaaactctgttcttcaatttgttcgactctccaggcgaactctttgacgagccgatattcatcacagtcgttgattcaaggagtttacgcaccgacgctctcctgggtgaattccggatggacgttggcacaatttaccgggagccgcggcacgcttacttaagaaagtggttgctcttatcggatcctgacgatttcagcgccggagcaagaggctaccttaaaacaagcctttgcgtgctgggacctggtgatgaagccccactcgagagaaaagacccatctgaagataaagaggacattgagtccaatctgctgcggcccacaggagtggctctcagaggcgcccatttctgtttaaaagtatttcgtgcagaagaccttccccagatggatgacgctgtgatggataacgtgaaacagattttcggcttcgaaagcaacaaaaagaacctcgtagacccttttgttgaggttagcttcgccggtaaaatgctttgtagcaagattttggaaaagactgcgaatccacagtggaaccagaatataactctgcccgccatgttccccagcatgtgcgaaaaaatgcggatcaggataattgattgggatcgcctgacacacaatgacatagtggccactacgtacctgagcatgtctaagatctctgcccccggcggggagattgaagaggagcctgcaggggcagtgaagccatccaaagcctccgacctggatgactacctgggattcttgccgacatttggcccctgttacatcaatctatacggttcccctagggagtttaccggattcccagatccttacactgaattaaataccggaaagggagaaggagttgcctatagaggacgcctgctgttatcgctggaaaccaagctggtggaacattctgaacagaaggtggaagacctccccgcagacgatattctgcgtgtggaaaagtatttgaggcgtcggaagtactccttattcgccgcattttattcagcaactatgctgcaagacgtcgacgatgcaatacagttcgaggtatccattggaaactatggtaacaaattcgatatgacatgtttgccgctcgcctcaaccacgcagtatagtcgtgccgttttcgacgggtgccactattactatctcccctggggcaacgtgaaaccagtggtcgttctaagctcatactgggaggatatatctcaccgaattgaaactcagaatcagctcctaggcatcgccgataggctggaggcaggtctggaacaggttcatcttgctctcaaggcacaatgcagtactgaggatgtagattccctggttgcccagctcaccgatgagctcattgccgggtgtagccagcctctgggggacatccacgaaacaccaagcgcaacacacctggatcagtatctttaccagctgaggactcaccacctgtcccaaattaccgaggcagcactggccctcaagttggggcacagcgaattacccgccgcccttgaacaggctgaggactggctcctgagactgcgcgccctggccgaagaaccacaaaactcccttccggatatcgtgatttggatgctgcaaggcgataagcgggttgcttatcagcgtgtaccggcccaccaggtgctcttctctaggcgaggcgcaaactactgtgggaaaaattgtggcaagctgcagactatcttcttaaaatatcctatggaaaaagtaccaggggcgaggatgccggtacagattcgggtgaaactgtggtttgggctgagcgtcgatgaaaaagaattcaatcagtttgcagagggcaaactgagcgttttcgccgagacatacgagaacgaaaccaagctggcactggtgggaaattggggaactacagggcttacctatcctaaattctctgacgttaccggcaaaatcaagctccccaaggatagctttcgtccctctgccggatggacttgggcaggcgattggtttgtgtgtccagagaagaccctgttacacgacatggacgccggacacctaagttttgttgaagaagtcttcgagaaccagacgcgcctgcccggcggccagtggatctacatgtccgataactacacagacgtcaacggagagaaagtactacccaaggacgatattgagtgcccactgggctggaagtgggaggatgaggaatggagcactgatctgaacagggccgtcgatgagcagggttgggagtacagcattaccattcccccagaaagaaaacccaaacactgggtccccgccgagaagatgtactacacccataggaggagaagatgggtgaggctgcgaagaagagacttgagtcagatggaggctctgaaacggcataggcaggctgaagcagagggtgagggctgggaatacgcgagtctgttcggttggaagttccatctggaatatcgcaagaccgacgcttttagacgccgaaggtggagacggcgaatggagcccctggaaaaaactggaccagcagctgtcttcgcgctggagggcgctctcggcggggtgatggacgataagagtgaagattctatgagtgtgtccacgctcagttttggtgtgaacagacctaccatttcctgtatcttcgattacggcaataggtaccacctgcgatgttatatgtatcaggcaagggatctggccgccatggacaaggactcatttagtgacccatacgctattgtctctttcctccaccaatctcagaaaaccgtcgtggtgaaaaataccctaaatcctacctgggaccagacccttatcttctacgaaattgaaatctttggcgagcctgcgacggtcgccgaacagccaccatccattgtcgtagaactttatgaccacgacacttacggagctgatgaatttatgggtcgatgtatctgtcagccaagcctggagagaatgcccaggttggcgtggttcccattaacgcgtggctctcagccgagcggcgaacttctcgccagcttcgagttaatccagagggagaaacctgctattcatcacattcctggctttgaagtgcaggagaccagcaggatacttgatgagtccgaagacaccgacttaccctaccctccgccccaacgagaggcaaacatttatatggtcccacagaacatcaaacctgctctccagcggacagccatagaaatactagcctggggactaagaaacatgaaaagctaccagttagcaaacattagctccccctccctggtggtagaatgtggagggcaaactgtccagtcatgcgtgatcaggaacctgcggaagaatccgaattttgatatttgcactctgtttatggaagtgatgcttcccagagaagagctctattgtccccccatcacagtgaaggtgatcgataatagacagttcggtcggcgtcctgtggtcggacagtgcacaattcgctcgttggaatcatttttatgcgacccctactccgccgagagtccaagccctcagggagggccggatgacgtgtctctgctgtctccaggtgaagacgtactgattgacattgacgacaaagaacctctcattccaattcaggaagaggaatttattgactggtggtccaagttttttgcatcaattggggaacgggagaaatgcggatcctatctggaaaaggatttcgatactttgaaggtatacgacactcagttggaaaacgtcgaagctttcgaaggcctgagcgatttttgtaacacgttcaagctataccgcgggaagacccaggaagaaactgaagacccttcagtgattggcgagttcaagggcctatttaagatttaccccttaccagaagatccggccattcccatgccgcctaggcagttccaccagttagccgcacaagggccacaggaatgccttgttagaatttatatagtaagggccttcggactgcagcccaaggaccccaatggtaagtgcgatccttatatcaagatttctatcgggaaaaagagtgtaagtgaccaggacaattatatcccatgcacactagagcccgtatttggcaaaatgtttgaacttacgtgtacattgcccctggagaaggatctcaagattaccctctacgactatgatctgcttagcaaggatgaaaaaattggcgagacggtggttgatttggaaaaccgacttctttcaaagtttggagcccgctgtggattgccacagacatattgtgtgtccgggcccaaccagtggagagatcaactacgccccagtcaattattgcatctgttctgccagcagcaccgggtcaaggcgcctgtatacaggacggatagggttatgtttcaggacaaagagtattccatcgaggaaatcgaagcaggacgtatccccaaccctcacttaggacccgtggaagaacgactcgcgttgcacgtcctacagcaacaggggctcgtgcccgaacacgtggaatcccgacctttgtactcccccctgcagccagatatcgagcaaggaaaactgcagatgtgggtggacctctttcctaaggcgttagggcggcccggccccccctttaatataaccccaagacgggccagaagattttttctgcgatgtataatctggaacactcgcgacgtcatccttgacgaccttagtctgaccggcgaaaagatgtcagatatctatgtcaaggggtggatgattggatttgaagaacataaacagaagactgacgtgcattatagatcactcggaggagaaggcaatttcaactggcgatttatcttccccttcgattacctgcctgctgagcaggtatgcaccatcgccaaaaaagacgccttctggagattagataagaccgaatccaagattcccgcgagagtcgtcttccaaatttgggacaacgacaaattctctttcgacgatttccttggcagtcttcagctggatctgaataggatgcctaagcccgctaagaccgctaagaaatgctctctcgatcaattagatgacgcattccatccagagtggtttgtgtcgctcttcgaacagaaaactgttaaagggtggtggccttgtgtggctgaagagggggagaagaagatattggcgggaaaactagaaatgactctggagattgtagccgaaagcgagcacgaggaacggcccgccggccagggccgggacgagcccaacatgaatcctaagctggaggatcccagacgcccagacacctcttttctgtggtttacctccccgtataaaacaatgaagttcatactgtggaggcggttccgctgggccattatcttgttcattatcctgtttattttgctcttgtttctggctattttcatttacgctttcccgaactacgcagccatgaagctagtgaagcctttcagctag

SEQ ID NO: 2475 - DNA, 6309 bp, Artificial Sequence
  Description of Artificial Sequence: Synthetic coding sequence
atgctgtgttgcctactagtgcgagcgagcaatctccccagtgctaaaaaggatcgacggtcagatccagtggcgtccctcacatttcgaggagtgaaaaaacgcacaaaggtcatcaaaaacagcgttaatccagtctggaatgaggggtttgaatgggacctgaaaggaatacctttggatcaggggtccgaactccacgtggtcgtgaaggaccacgaaactatggggcggaaccggtttcttggggaggcaaaagtaccactgcgtgaagtacttgctaccccgtcgctttccgcttccttcaacgctccattattggataccaagaagcagccaacaggggcttcccttgtgctccaagttagctacactcccctgccaggcgccgtgcccctttttccacctcccacccccctggaacccagccctactctccctgatttggatgtggtggcagatactggaggggaggaagatactgaagaccagggtctgaccggagatgaagctgagccatttctagaccagagcggcgggccaggtgcacccacaacaccaagaaagctcccgtcacgaccgcccccccactatccggggatcaagcggaaacggtcagctcccacatcacgcaagctgctctccgataaacctcaagattttcagatcagagtccaggttatcgaaggccgccaattgcctggagtcaacataaagcccgtcgtcaaggttaccgctgccggccaaactaaaagaacaagaatccataagggaaactccccactctttaatgaaactctgttctttaaccttttcgacagcccgggtgagttatttgatgagccaatcttcatcacagtggtggattcgcggtctctaagaaccgatgctctcctgggcgaattccgtatggatgtgggcactatctatagggagccccggcatgcctacctaagaaaatggctgcttctcagcgaccctgacgattttagcgcaggcgcccgcggctacctcaagaccagcctgtgcgtcctgggacccggggacgaagcacccctggaacgcaaggatccctcagaggataaggaggatattgagagcaacttacttcgtcctactggtgtagccctacgtggcgctcacttttgtctcaaagtgttccgcgctgaggacttacctcagatggatgacgcggtgatggataacgtcaagcaaatcttcggattcgagtcaaacaaaaaaaatctggttgacccatttgttgaggtgagtttcgctggcaaaatgctctgctctaaaatcctggagaaaaccgccaatccccagtggaatcagaatatcaccctgccggcaatgtttcccagtatgtgtgagaagatgcggattcgtattattgactgggatcggctaacccataacgatattgtcgccactacttatttgtctatgtcaaagatcagtgctcctgggggcgaaatcgaggaggaaccggccggagccgtcaagcctagcaaagcctcagacctcgatgactatctggggttccttcccacatttggaccgtgctacatcaatctttatggatctcccagggagttcaccggcttccctgatccgtatactgagctgaacaccggaaagggagaaggcgtggcttaccggggcagactcctgctctcattggaaacgaagctggtcgaacactcagaacagaaggtagaggacctccccgccgatgacatcttaagagtggaaaagtatctgaggagacgcaaatactcgctgtttgctgcattctactcagccactatgctccaggacgtcgacgacgccattcagttcgaagtgtcaattgggaactacgggaataaatttgacatgacctgcctgcccctggcttcaacgacgcagtactcacgagctgtttttgatgggtgccattattattatttaccgtggggaaacgtgaagcccgtagtcgtactgtcctcgtactgggaggatatctctcacagaatcgaaacacagaatcagttacttggcatcgccgaccggttagaggctggcctggagcaggtccatttagcgttaaaagcacagtgtagtactgaggacgtggactctcttgtcgcacagctgacagacgaattaatagcggggtgttctcagcctttaggcgatattcacgagacgccaagcgcaacccacttggaccaatatttgtatcagcttcggactcatcacctctcacagatcacagaggccgccctcgccctgaaactgggtcattcggagctacctgcagcacttgagcaagccgaggattggttgttgagattgcgtgcccttgcggaagagccacaaaactctctcccagacattgtgatatggatgctacagggggacaaacgtgtggcctatcagcgcgtgccagcacatcaggtgttattcagccgccgaggagctaattactgtgggaaaaactgcgggaaactccaaactatcttcctgaagtatcctatggaaaaagtgcccggcgcccgcatgcccgtccagattagagtcaagctctggttcggcctgtctgttgacgagaaagaattcaaccagtttgccgagggcaaactcagtgtattcgcagaaacatacgagaacgaaacaaagcttgccctggtcggaaattggggtactaccggcctgacctatcccaaattttctgacgtgacgggtaagattaagcttcccaaggattctttccggccgtcagccggatggacatgggcgggggattggtttgtgtgccccgagaaaaccttgttgcatgacatggacgcagggcatctgtcttttgtcgaagaggtgtttgaaaatcaaaccagattgccagggggacagtggatttatatgagtgacaattacacagacgttaatggcgagaaggtgctgccaaaagatgatatcgaatgccctttgggatggaagtgggaggatgaagaatggtctaccgacctcaatcgcgccgtggatgagcagggatgggagtacagtatcacgattccccccgagcggaagcctaaacactgggttccagccgagaaaatgtactatacccaccgccgaaggagatgggtccgcttgaggaggcgagatctgtctcagatggaagccctgaaaaggcacaggcaagcagaggctgagggcgaggggtgggagtatgcctccctctttggctggaagttccacctcgagtacagaaaaacagatgccttccggaggcgccgatggaggaggcggatggagcccctcgaaaaaacagggcctgccgctgtatttgccctagaaggtgccctggggggcgttatggatgacaagagcgaagacagcatgtccgtatctaccctgtcctttggcgtgaaccgaccaacaatcagctgtattttcgactatggaaatcgatatcacctgagatgttatatgtaccaggccagagacctcgcagctatggacaaggacagtttcagcgacccctatgccatcgtgtcctttttacaccagagtcagaaaaccgtggtggtcaagaatactctgaatccgacatgggaccagactctgattttttacgagatagaaattttcggcgaaccagccaccgtggccgagcagccgccgagcattgtggttgaactgtacgaccatgacacatacggggcagacgagttcatgggtagatgtatctgtcagccctcactcgagcggatgccacggcttgcttggtttcctttaactcgtgggagtcagccgagcggagagttgttggcatcttttgagctgattcagagggaaaagcctgcaatacaccacatcccagggttcgaagtccaagaaacttcgcgtatcctggatgagtccgaggacacggacttaccataccccccaccacagagagaagccaacatttacatggtcccccaaaacatcaagcctgctctccaaagaacagcgattgagattttggcctgggggttgcgaaacatgaagtcttaccagttggcaaatatatcctcaccgagcctagtcgtggagtgtggcggacagactgttcagtcgtgcgtgatccgcaatcttagaaaaaaccctaattttgacatatgtacactctttatggaggtcatgctgccacgagaagagctttactgcccacccatcactgtgaaggttattgataatcgccaatttggacggagacccgtcgtagggcagtgcacaattagatcgctggagtcttttctgtgcgatccatactcggcagagtcaccctcaccccagggaggaccagacgacgttagtctgctaagtcccggcgaggatgttttaatcgacattgatgataaagagccgttgatccccattcagctggcagacggcttgtcatccctggcgcccacaaatacagcttcgcctcctagctctccacatgaggaagaatttatcgattggtggtccaaattttttgccagcatcggcgaacgagagaagtgcggcagttacctggaaaaggacttcgacactttgaaagtgtacgatacacagttggagaacgtggaagcattcgaaggactgtcggacttttgtaacacctttaaactgtaccggggcaaaacacaggaggagaccgaggacccctcagtgatcggtgagttcaagggcctgttcaagatatatcctctgcccgaggaccccgccatacctatgcctcctcggcagtttcaccagttggcggcccaaggcccacaggaatgcctcgtcaggatctatatcgtgagagcctttggcctacagccaaaagatcctaacggcaaatgcgacccatacattaagatcagcattggcaaaaagagcgtatctgaccaggacaactacattccgtgcacactagaaccagtatttggcaagatgttcgagctgacatgtaccctcccactcgagaaagacttaaagatcacactttatgattacgatctgctctctaaggatgaaaaaattggagaaacggtcgtggatctggagaatagactgctttccaagtttggcgcccgctgtggccttcctcagacctattgcgtttctggtccaaaccagtggagggaccaactccggccaagtcaacttcttcacctgttctgtcaacagcaccgcgtgaaggccccagtttaccggaccgacagagtgatgttccaggacaaagagtactccatcgaagaaatagaagccgggaggatccccaatccccacctcggaccggtggaggagcggctcgctctccatgtgttacaacagcagggccttgtgcccgaacacgtggagagtaggccactgtattcaccacttcagcctgacattgagcaaggtaaactgcagatgtgggtggatttgttccctaaggccctgggtcgcccaggccctcctttcaacataaccccacgtcgtgcccgacggttctttttgcgttgcatcatctggaacactcgggacgttatcttagatgacctgtccctgaccggggagaaaatgtccgatatttacgtgaaggggtggatgataggattcgaagaacacaagcagaagacagatgtgcactaccgttccctcggaggtgagggaaattttaattggagattcatcttcccattcgattatcttccggctgaacaggtatgcacaattgccaagaaagacgccttctggagactggacaaaacagagagcaagattcctgcgcgagtggtctttcaaatttgggacaacgacaagttctccttcgacgatttcctgggaagtctccaactggacctgaacagaatgccaaaaccagcaaaaaccgctaagaagtgctctctggatcagctggatgatgcctttcatcctgagtggttcgtctccctctttgagcaaaagactgtgaaaggctggtggccatgcgtggcggaggaaggcgaaaaaaagatcctggcaggcaaactggaaatgactctggagatagtcgcagagtctgaacatgaggaaagaccagcgggtcagggtagagacgagcccaacatgaatccgaagcttgaagatcctcgacgcccagatactagttttctgtggttcacttctccatacaagaccatgaaatttatactctggagacgcttccggtgggctatcattttgttcatcattctcttcatcctgcttctgtttctcgctatcttcatctatgctttcccaaactatgcggcgatgaaattagttaagcctttctcctag

SEQ ID NO: 2476 - DNA, 6357 bp, Artificial Sequence
  Description of Artificial Sequence: Synthetic coding sequence
atgctcagggtcttcatcctgtacgctgagaacgtgcatacccccgacaccgatataagcgacgcttactgttccgccgtgtttgccggtgtcaagaagcgcaccaaggttatcaagaacagcgtgaatcccgtttggaatgagggattcgaatgggacttgaaggggattcccttagatcaagggagcgagcttcacgtggtggtgaaggatcacgagaccatgggacggaatagattcctcggggaagccaaggtgcccctgcgcgaagtactcgccaccccatccctctccgcttcttttaatgcccctcttctggacacaaagaagcagcccactggcgccagtcttgtactccaggtgagttacacaccattgccaggagccgtacctctattccccccaccaacgccactcgagccgtctccgaccttgccagatctggatgtcgtagccgggggaggtcaatcccgcgcagagacttggtccctgctgtctgatagtaccatggataccagatattccggaaagaaatggcctgctccgacagacactgggggggaggaggataccgaggatcaggggctaaccggggacgaggctgagccatttctggaccagagcgggggtccgggggcccccaccaccccacgtaagcttccaagccgccccccgccgcactatcctggtataaaacgcaagcgttccgcacccacctccaggaagttattgtcagataagcctcaggatttccagattagagttcaggtcattgaaggtaggcaactgcccggggtgaacattaagccagtggtcaaggttaccgctgccggccagacaaaaagaacaaggatccataagggcaactctccactgttcaacgagacgctcttctttaacctgttcgattcgccaggggaattattcgatgagccaatttttatcactgtcgtggatagtaggagtctcaggaccgatgctctgctgggcgagttccggatggacgtcggcacaatatatcgcgagccaaggcatgcatatctgaggaaatggttgctccttagcgatcccgatgacttcagtgctggcgcacgagggtatttaaagacctcactgtgcgtcctgggtccaggggatgaggccccgctggaacggaaagacccctccgaggacaaagaggacattgaatccaatttgcttcggccaacaggagtcgcccttcgcggggctcacttttgcctgaaggttttcagagcagaggatctcccacaaatggacgacgccgtaatggataatgtgaagcaaatatttggttttgaaagcaataaaaaaaatctggttgatccattcgtagaagtctcgttcgccggaaagatgctatgtagtaaaatactcgagaagaccgcaaacccccagtggaatcagaacatcactctgcccgcaatgtttcctagtatgtgtgaaaaaatgcgaatccgtatcatcgactgggatcgcctgacgcataacgacatcgtcgccacaacatacctctccatgtctaagattagtgcccccgggggagaaattgaggtggacgattacctcggatttctccccacatttggcccttgttacatcaacctgtacggttcaccgagagagtttactggctttcctgatccttataccgagctcaacacagggaaaggcgagggtgttgcatatcgcggacggttgttactgtctctcgagaccaagcttgtcgagcattccgagcagaaagtggaagacctgcctgcggacgatatcttgcgcgtggaaaagtacttacgacgaaggaagtactcacttttcgccgccttctatagtgctaccatgctccaagatgttgatgatgcgatacagttcgaagtcagtatcggcaattacgggaacaaatttgacatgacctgcctgccattagcttccactacccaatatagtcgtgccgtgtttgacggttgtcattactattacttaccttggggcaacgtgaagcctgtggtcgtcctatccagttattgggaggacatatctcatcggatcgagacgcaaaatcagctgctgggtatcgctgatcggttggaagcgggattagaacaggtacacttggccctgaaagcccagtgcagcaccgaagatgtcgatagcctggttgctcagctgacagacgagttgattgcaggctgcagtcagccccttggcgacattcatgaaacaccttctgcaacacatctggatcaatacttataccagctgcgtacgcaccacctaagccagattaccgaggctgccttggcgctgaagctgggccactctgaactgccagcggccctggaacaggccgaggactggttgctgcgactcagagccttagccgaggagccccaaaatagcctaccagatattgtgatctggatgctgcagggggacaagcgggtcgcctatcagagagtccccgcccaccaagtgctgtttagcaggaggggggcaaactactgcggcaaaaactgtggtaaattgcagacaatttttcttaaatatcccatggagaaggttcccggcgctcgaatgccggtgcagattcgggtcaagttgtggtttgggctctccgtggatgaaaaagagtttaatcaatttgcagaaggcaagctgagcgtgttcgccgaaacatacgaaaacgaaacaaaactagccctcgtcggcaattggggtaccactggactgacataccccaagttttctgacgtcactggcaagatcaaactgccaaaggactcttttcgaccgtccgcaggttggacatgggctggagactggttcgtgtgccctgaaaagacactgcttcatgatatggacgctggccacctttcctttgttgaggaagtgttcgaaaaccagactcgcctaccagggggccagtggatatacatgtccgataactatacggatgtgaacggcgaaaaggtgttgcccaaggatgacatcgagtgccccctgggatggaagtgggaggacgaggagtggagcacagaccttaatcgggctgtagacgaacaaggctgggaatattcgattacaattccacccgaaagaaagcccaagcattgggtgcccgctgaaaaaatgtactatactcatcgacgacggcgatgggtcagattacggcggcgggacctgagtcagatggaagctctcaagcgccaccggcaagcagaggccgaaggtgaggggtgggagtacgctagcctgttcggctggaaattccatctcgagtaccggaagactgatgcgttcagacggaggagatggcgaagaagaatggagcctctggagaagacaggtccggccgctgtgtttgcactggaaggtgctctgggcggcgtgatggacgataaatctgaggatagcatgagtgtcagcaccttgtctttcggagtgaataggcctacaattagctgcatcttcgattacggcaacagataccacctgcggtgctacatgtatcaggctcgggatctggccgcaatggacaaggactctttttcagatccatatgccattgtgtctttcctgcaccagtcgcagaaaacagtggtggtgaagaatacattaaatccaacttgggatcagacactcattttttatgaaattgaaatctttggggagccagccacagtcgctgaacagccaccctccatcgtggtggaattatacgatcacgatacctatggtgccgatgaatttatgggtcgatgtatatgccagccatctctcgagcgtatgcccaggttagcatggtttccgctgacccgggggtcccagccaagtggagaattgctggcctccttcgagctcatccagcgggaaaagcccgctattcaccacatcccggggtttgaagtccaggaaacttcaaggatcctggacgagtccgaggataccgacctgccatatccaccaccgcaacgggaagctaatatctacatggtccctcaaaacatcaaacctgccttgcagcgcacagcaatagagatcctagcttggggattgcggaacatgaaatcttaccagctggccaacatttctagtccttctttagtggtcgagtgcggtggacaaaccgtccagtcgtgtgtcattcggaacctaaggaagaaccccaatttcgacatctgcacgctgtttatggaagtaatgctgcctcgagaggaattgtactgccccccgattacagtcaaagtaatcgacaatcggcagttcgggaggagacccgtagttgggcagtgtaccatcaggagcctcgaatcatttctctgcgatccgtattcagctgagtctccgagcccacagggtggcccggatgatgtctccttgctgtctccgggagaagatgtgttaatcgatatcgacgacaaagaacctcttattccaattcaattggcagatggcctgagctctttggcccctacaaatactgcgagcccaccaagttctccacatgaggaggaattcattgattggtggtccaaattcttcgctagcattggcgaaagagagaagtgtggctcctatctggagaaggatttcgatactctgaaagtatacgatacacaactcgaaaacgttgaggcattcgaaggactttctgacttctgcaacacatttaagctctacagagggaagactcaggaggaaaccgaggatccttctgtgatcggggaatttaagggcttgtttaaaatatatccattgcccgaagaccctgctataccgatgccacctaggcaattccaccagcttgccgcccaggggcctcaggaatgtctggttcggatctatattgtgagggcattcggactccaaccaaaagaccctaatgggaagtgcgatccttacatcaaaatttctattggcaagaaaagcgtgtcggatcaggacaattatatcccctgcacccttgagccggtgttcggcaagatgttcgaacttacttgtaccctgccactcgaaaaggacttaaagatcaccctgtacgattacgatctgctcagtaaggacgagaaaattggagagaccgttgttgatctcgaaaataggctcttaagcaagtttggcgctcggtgcggcttgccccaaacttactgtgtgtctggacctaatcagtggagggaccagctgcggccaagccagctgttgcatctgttctgtcagcaacatagagtgaaagctcccgtctatcgcactgaccgggttatgttccaggataaagagtactctatcgaagagatcgaggctggccgtatccctaatcctcacctgggacctgttgaagagcggctggccctccatgtgctacagcagcagggtctggtcccggaacacgttgagtctcggcctttatactctccactgcagcccgatattgaacaagggaagctgcagatgtgggtggacttattccccaaggccttgggcagacccggcccccctttcaacattacacccagaagagctaggaggttcttcctgagatgcatcatctggaacactcgcgacgtaattctggacgacctcagtctcaccggggagaaaatgagcgatatctacgtaaagggctggatgatcggatttgaggagcacaagcaaaaaacagacgtccattaccgctctctagggggcgagggtaactttaactggcgcttcatctttccttttgattacctgcccgccgagcaggtttgtacgatcgccaagaaagacgctttttggcggctcgataagaccgagtctaagataccggcacgagtagtttttcagatatgggataatgacaagttctcatttgacgacttcctgggctcactccaacttgacctgaacagaatgccaaaacctgctaagactgccaaaaaatgcagtctagaccaactggacgacgctttccaccctgagtggtttgtcagcctgttcgagcagaaaaccgttaagggttggtggccttgcgtcgcagaagaaggtgaaaaaaaaattttagccgggaaattggagatgaccctcgaaatcgtcgcagagtccgagcacgaggagagacccgccgggcagggcagagacgagcctaacatgaaccctaagctggaggaccccagaagaccagacactagctttctgtggtttacaagtccatacaaaaccatgaaattcattctgtggagaaggttccgttgggcaataattttgtttattatactatttattctcctcctgttccttgccatatttatctacgcgtttcctaactacgccgctatgaagttagtcaagcccttctcgtag

SEQ ID NO: 2477 - DNA, 6339 bp, Artificial Sequence
  Description of Artificial Sequence: Synthetic coding sequence
atgctctgttgcctgctcgttcgggcttcaaatctgccgtccgccaaaaaggatcgcaggagtgatcctgtggcttcactcaccttcagaggcgtcaagaagcgaacgaaggtgatcaagaattcggtgaaccccgtgtggaacgaagggttcgaatgggacctgaaaggtatccccttggatcagggctctgagctgcatgtggttgtgaaggatcacgaaaccatggggcgtaatcgtttccttggagaggcaaaagtgccccttagagaggttcttgccaccccctccctttctgcttcttttaatgcccccctcctggacacgaaaaagcaaccgaccggggccagtctggttctccaggtctcgtacactccccttcccggagcggtacccctcttccctcctccgactcccctcgaaccgtctcctaccctgcccgatctggatgtagtggcaggtggtggtcagtctagagccgagacctggtcactgttatctgacagtacaatggatacgcgctacagcggaaagaaatggccagcccccacagacaccggaggcgaggaagataccgaagaccagggcctgacaggagacgaggccgagccctttctagaccaatccggcggcccgggcgctccaactacacctcggaagctgccctccaggcctcccccccattaccccggcatcaaacgtaaacggagcgcccccacatctaggaagctcctttcagataagcctcaggactttcagatcagggtgcaagtaattgaggggcgccagctccccggggtaaatattaaacccgtggtgaaagtgaccgctgcaggacaaaccaaaagaactaggattcacaaggggaattcgcctttattcaatgaaacactctttttcaacctgttcgactcgcctggggaactgtttgatgagccaattttcatcaccgtggtggactccaggagcttacgcacggatgcgctgctgggggaatttaggatggacgtcggcactatatatagggagcctcggcacgcttatctcagaaaatggcttctgttatctgacccggacgacttttcagctggcgcccggggatacctgaagacctctttgtgcgtacttggcccaggcgatgaggcccccctggagcgaaaggacccttcggaggacaaagaggacattgaatctaatctcttgcgccccaccggggtggcacttcgcggggcccacttctgtctgaaggtgtttagggctgaagatttacctcaaatggacgacgcggttatggacaacgtgaagcagatcttcggattcgaatccaataagaagaatctcgtagacccgtttgtggaggtctcatttgccggaaaaatgctctgttccaagatcctggagaaaacggcaaatcctcagtggaatcaaaacataaccctccctgcaatgtttccttctatgtgcgagaagatgcgtatcaggatcattgactgggaccgtttgacgcacaacgacatcgtcgctaccacttatctatcaatgtcaaagatctccgctcccggtggcgagatcgaggaagagcctgccggcgccgtaaagcccagcaaggctagtgacctggacgattaccttgggttcctgcctacctttggcccatgttatataaacctctatggcagtccaagagaattcactggcttccccgatccctacactgaactgaacaccggcaaaggcgaaggcgtcgcttaccgtggccgtttactgctgagcctggaaacaaagctggtggagcactcagaacagaaagtggaagaccttcccgccgatgatatcctgcgggtcgaaaagtacctgaggagaaggaagtacagtctgttcgcagctttttactccgctactatgctgcaagatgtagacgacgcaattcagtttgaggtttcgatcggaaattacgggaataagtttgacatgacctgtctgcctctcgcatctactactcagtactcacgcgccgtcttcgatggctgtcactattactaccttccatggggcaatgtgaagcctgtcgtggtgctcagttcctattgggaagacatttctcaccgcatcgagacccagaaccagctgctcgggattgccgataggttggaagccggtctggagcaggtgcacctcgccttaaaggcccagtgtagtaccgaagatgtggatagcctggtggcccagctaacagatgagcttatagctggctgttcccaaccactcggggacattcacgaaacccctagtgctacccacctggaccagtatctctaccagcttaggactcaccatctgagccagatcaccgaagccgcccttgctcttaagttggggcacagtgaacttcccgccgccctcgaacaggctgaagactggctcctccgcctgagggcattggcagaggagcctcagaattcgctccccgacatagtgatctggatgctccaaggtgacaagcgcgtggcttaccaaagagttccagctcaccaggttctgttttctcggagaggtgctaattattgcggcaaaaactgcggcaagttgcaaaccatctttcttaagtaccccatggaaaaagtccctggagccagaatgcctgtccagatacgcgtgaagctgtggttcggtctgtccgtagatgaaaaggaattcaatcagtttgcagaaggcaagctttctgtgtttgccgagacctacgaaaatgagactaagttggcactagtcgggaactggggaaccactggactgacctacccaaagtttagtgatgttactggtaaaataaaactgcccaaggactcttttcggcctagcgccgggtggacatgggcaggggactggttcgtgtgcccagagaagactctgctccatgacatggacgctggacacctcagtttcgtggaggaggtgttcgagaatcaaactcggctgcctggcggccagtggatctacatgtccgacaattatacggacgttaacggcgaaaaagtgttgcctaaggatgacatcgaatgccctctgggctggaagtgggaagacgaggaatggagcactgacttaaatcgtgccgtagacgagcagggatgggagtacagcatcaccatcccccccgagcgtaagcccaaacactgggtaccagctgagaagatgtattacacacaccgccggcgaaggtgggtacgcctgcgccgaagagacctgagtcaaatggaagctttgaagcgccacagacaagccgaggccgaaggagaggggtgggagtacgcctcactattcgggtggaagtttcatctcgagtaccgtaagacggacgcatttcggcgcagaaggtggcggaggagaatggaaccactagagaagacagggcctgctgctgtctttgccttagaaggggcgctgggcggggtgatggacgacaagtcagaagacagtatgagcgtgagtacactgagtttcggagtcaaccggcccactatctcctgcatcttcgactatggaaaccgctatcacctgagatgttacatgtatcaggccagagatctggctgcaatggataaggattctttttctgacccttatgccatcgtgagctttctccatcagtcacagaaaactgtggtggtgaaaaataccctcaaccccacctgggaccagacattgatcttctacgagatcgaaatcttcggcgaaccagccacagtggccgaacagcccccatcaatcgtagtggagctctacgatcacgatacatatggtgcagacgagttcatgggccggtgcatatgccagccatctctggagcgaatgccacgattagcctggtttcccctgacacgtggaagtcagccctccggtgagctgctggcaagttttgaactcatccagcgcgagaaacccgcaatccaccacattcctggcttcgaagtgcaggagacatcccgcatcctcgacgagagtgaggatacggatctgccatacccccccccacagcgggaggcgaacatttatatggttccgcagaacatcaaacccgcactacaacgtaccgccatcgagatactggcatggggcttgcgtaacatgaaatcatatcagctggctaatatctctagcccctccctcgtggtcgagtgcggtggacagactgtgcaaagttgtgtgatccgtaaccttaggaagaatccaaattttgacatttgtacactatttatggaggtgatgttgcccagagaggagttatactgtccacccatcacagtgaaggttatcgataatcggcagtttggtcgtagacccgttgtgggtcagtgtacaattcgctccctcgaaagcttcttatgcgacccttattctgcagaatccccaagtcctcagggcggcccagatgacgttagtctactgtccccaggcgaggatgtgctaatagacatcgatgataaggaacctctcattcccattcaggaagaagagtttatcgattggtggtccaagttctttgctagtataggagagagggagaagtgtggcagttacctcgaaaaggacttcgacaccttgaaagtgtacgacacacagttagagaacgtggaggcgtttgaaggcttatctgacttctgcaacactttcaaactctaccgcggcaaaacccaggaagagactgaagatccttcagtcatcggggaatttaagggcctgttcaagatctacccactgcctgaggacccagccattcccatgccccccagacaatttcaccaattggctgcgcagggaccacaggaatgcctggttcgaatctacattgtccgcgcattcggtctgcagcccaaggacccaaatggaaaatgtgatccttacatcaaaataagcatcggcaaaaagagcgtgtccgatcaggacaactacatcccctgcaccctagaacccgtgttcgggaaaatgtttgagctcacatgcactctccccctggaaaaggacctcaaaattactctgtatgactacgacctgctatccaaggacgagaagatcggagagaccgtagttgatctggagaatcggctgctgtctaagttcggcgcacgttgcggattgccacagacatattgtgtgagcgggccgaatcagtggagggatcagcttcggccgagtcagttgctccacctattctgtcagcagcatcgggtcaaggcccccgtgtaccgcacagatagggtcatgtttcaagacaaagaatattctatcgaggagatcgaggccggtagaatccccaacccccacctaggccccgtggaggaaaggcttgcgctccacgtgctgcagcagcagggtctggttcctgagcacgtggagtctagacctctctactctcctttgcagcctgacattgagcaggggaagctgcagatgtgggttgacttattccctaaagccctcgggcggccagggccccccttcaatatcacgccccgaagagccagacggttctttcttcggtgtatcatatggaacactagggacgttatcctggacgatcttagtttaacaggagaaaaaatgtccgacatttacgtgaagggttggatgattggcttcgaggagcacaagcagaaaacggacgtgcattacagaagcttagggggcgagggcaactttaattggagattcatatttccattcgattatctcccagcggagcaagtatgcactattgctaagaaggatgccttctggcggctggacaaaaccgaatcaaagatccccgcccgagtcgtgtttcaaatctgggacaatgacaagttttcctttgacgatttcctgggcagccttcaactggacctgaaccgtatgccaaagcctgcgaagacagccaagaaatgtagtcttgatcagctggacgatgcctttcatcccgagtggtttgtgtccctgtttgagcagaagactgtgaagggttggtggccctgcgttgcggaggaaggtgaaaaaaagatcctcgccgggaaactggagatgacattggagatcgttgcagagtctgagcacgaggaaaggccagccggccagggaagagatgaaccaaacatgaatcctaaacttgaagaccccagacgacccgatacttcttttttgtggtttacatcaccgtacaagacaatgaagttcattctttggcgccgtttccggtgggccattattctcttcatcattctcttcattctactgttgttcttggctatcttcatttatgctttccctaattacgccgctatgaagttggtgaaacctttcagctag

SEQ ID NO: 2478 - DNA, 6267 bp, Artificial Sequence
  Description of Artificial Sequence: Synthetic coding sequence
atgctctgctgcctactggttcgcgccagcaatctcccatcagcaaagaaagacagacggtcggatccagtggcgtctctgaccttccgcggagtcaaaaagagaacaaaggtcatcaagaatagtgtcaatccagtgtggaacgaaggctttgaatgggacctgaaaggtattcccttggaccagggtagcgaattgcatgtcgttgtgaaagaccacgagacgatgggaagaaatagatttctgggtgaggctaaagtgccccttcgcgaggtattggccacaccgtcactgagcgcgagtttcaatgctccattgctagatactaagaaacagcctactggtgcttctctcgtcctgcaggtgagttacacgccgttgcccggagctgtcccgctgttcccccctccaacccctttggagccctcccctaccctcccggatttggacgtcgtggctgacacagggggagaggaggacacagaagatcaggggctcacaggtgacgaagccgagccttttctggaccaatctggcgggcctggggcaccaacaactccacgcaaactgccatctaggcctccgccccactacccaggcattaagcggaagcggtccgcacccacatcccgtaaactattgagcgataagccccaggatttccagataagagtgcaggttatcgagggccgtcagcttcccggcgtgaacatcaagccagtcgtgaaagtgactgccgccggccagaccaaaagaaccaggattcacaagggaaacagtccattattcaatgagacgttgttctttaacctgtttgactccccaggtgagttgtttgacgagcctatcttcattactgtcgtggattccagaagcttgagaaccgatgccctgctgggtgagttccgcatggatgttggtaccatttatcgggaaccccgacatgcttacctgcgtaagtggttgcttttgtccgatccagatgacttcagcgcgggggcccgaggctatttgaaaacatctctgtgtgttctgggccccggagacgaggcgcctcttgaaagaaaggacccatccgaggacaaagaggacattgaatccaatttgctgagaccaacaggagttgcattgagaggcgcccacttctgtctgaaggtgttccgcgcagaagacttgccccaaatggatgatgctgttatggataatgtgaaacagatttttggctttgaatccaacaaaaagaacctggtggacccattcgttgaagtgtccttcgcgggtaaaatgctgtgtagcaagattctggaaaagactgctaacccgcagtggaaccagaacataactctgcctgccatgtttccatccatgtgtgagaagatgcggatcaggattatagactgggatagactgacccacaatgacatcgtcgctactacatacctgagtatgtcaaagataagtgctcccgggggggagattgaagtcgatgattatctgggattcttaccgacattcggcccatgttacatcaatttgtacggcagtccgcgcgaatttacaggattccccgacccctacactgagctaaataccgggaaaggagagggagtggcttatcgagggcggctactgctgagccttgagacaaagctggttgagcactctgagcagaaagtggaggacttacctgctgacgatatcctgagggtggagaaatacctccgcagacgcaaatacagccttttcgctgctttttatagtgctacaatgctccaggatgtggacgatgccattcagtttgaggtctccattggcaactacggaaataagttcgatatgacctgcttgccacttgcaagcactacacagtactcccgggccgtgttcgacggctgccattattattatctaccctgggggaacgtaaagcctgtggtcgtgctctcctcctattgggaggacatcagccatcgtatagaaactcagaatcaactgctcggtattgcagacaggttggaggccggacttgaacaagtccacttggccttaaaagctcagtgctctacagaggatgtagattctcttgtggcgcaactgacagacgagctgatcgcggggtgtagtcaaccactgggcgacatccacgagacaccttccgccacacatcttgaccagtatctgtaccagctgagaacccaccatctgtcacagattacagaagccgctttggctctcaaactgggccacagtgaactcccagctgccctggaacaggccgaggattggctgctgcggctgcgggcactggctgaagagccacagaactctctgccagacattgtgatttggatgttacagggggacaaacgagtcgcctaccagagagtgcccgctcaccaggtgttattctcccgaagaggtgccaattattgcggtaaaaattgcggcaagttacagacaatctttctgaaatatccaatggagaaggttcctggggccaggatgccggtccagatccgcgtcaaactctggttcggcctctcagtggacgaaaaggaatttaatcaatttgcagaaggcaagctcagcgtcttcgccgagacctacgaaaatgaaacaaagctggcactcgtgggaaattgggggactactgggttgacgtacccaaagtttagcgatgtgacgggtaaaatcaagttacccaaggacagcttccggccctccgctggatggacttgggccggggactggtttgtatgtcccgagaaaacgcttctgcatgatatggacgccggtcatctgagcttcgtggaggaagtattcgaaaaccagacccggttgccaggaggacagtggatatacatgtcagataactacactgatgtgaacggtgaaaaagtactgcctaaagacgacattgaatgtccgctgggctggaaatgggaggatgaggagtggtcgactgacctgaatcgggctgtcgacgagcaaggatgggaatactccattactatcccccctgagcgcaaacccaaacactgggtgcctgctgaaaagatgtactacacacaccgacgccggcgttgggtgcgtctgaggcggagagacctgtcccagatggaggctctaaagaggcaccggcaggctgaggcagagggtgaaggctgggaatacgccagtctgtttggatggaagtttcaccttgaatacagaaaaacagatgctttcagacgcaggagatggcgtcgacgaatggaacccctagagaagacaggccccgcagctgtgttcgcgcttgagggcgctctgggcggtgttatggacgataaaagcgaggactctatgagcgtatccaccttgtctttcggagtgaatcggcccactatctcgtgcatatttgattacggcaatcgatatcacctgcggtgttatatgtaccaggcccgtgacctagctgccatggataaagatagctttagcgacccatacgccatagtcagtttcctgcaccagagccagaaaacagtcgtcgtgaaaaatacgctcaatcctacatgggatcagactttaatattctacgagatcgaaatctttggggagccagcgaccgtcgccgaacaaccgccctccatcgtagttgaactatatgatcatgatacgtatggggctgatgagttcatgggacggtgtatctgccagccctcgctggagaggatgcctagactcgcctggtttcccctgacccgaggctcacagccatcaggtgaactgctagcaagttttgagcttatccagcgtgaaaaaccggccatccatcatataccgggtttcgaggtgcaggagacaagcagaatccttgatgagtctgaagatacagatctgccttatcccccgcctcaaagagaggctaacatttacatggtgccacaaaacattaagcccgcgctgcagaggaccgcaattgaaatcctggcctggggcctcaggaacatgaagtcctatcagcttgcaaatatatcctcacctagcctggtagttgagtgtggaggacagaccgtccaatcctgtgtcataagaaatctgagaaagaatccaaactttgacatctgcacactcttcatggaggtgatgctacctcgagaagaactctattgtccacctattacggtcaaagtgatcgacaatcggcagtttggtaggaggccggttgtcgggcagtgtaccatcagatctctggagagctttctttgcgatccatattctgcggaatcccctagtcctcaaggcgggccagacgacgtatcgctgttgagccccggtgaagacgtcctaattgacattgacgacaaggagcccttaatcccaatacaactggcagatgggctgtccagccttgccccaacgaataccgcatcaccaccctccagtccacatgaggaggagtttattgattggtggagcaagttcttcgcatcaattggagagcgggagaaatgcgggtcttacttggagaaggattttgacactctcaaggtctacgacacacaactggagaatgttgaagcatttgaggggctctccgacttttgtaatactttcaaactgtacagggggaagacccaggaggagactgaagacccttccgtgatcggggaattcaaaggactcttcaagatttatcctctgcctgaggaccctgcgatccccatgcctcctcgacaatttcatcaactggccgcacaaggaccgcaggagtgtctagtccgcatatacatcgtgcgcgccttcgggctccagcctaaagatcctaacggcaagtgtgatccgtatattaagatctctatcggcaagaagagcgtcagcgatcaagataattacattccctgcacacttgagcccgtctttggcaaaatgtttgaattgacttgcaccctaccactggaaaaggacttaaaaataaccctctacgactacgacttactgagtaaggacgaaaaaattggcgaaacggttgtggacctggaaaatcggctcttgtccaagtttggggcccgatgcggactgccccagacttactgtgtctccggccccaatcagtggcgggatcagttgaggccgagtcaactactccatctgttctgccagcagcaccgggtgaaggcgcctgtttacaggacagaccgcgtgatgttccaagataaagaatactcgattgaggagattgaggcaggccgcatcccaaaccctcaccttggccccgtggaggagaggcttgcgttgcacgtattacagcagcaaggtctggtcccggaacacgttgaatccagaccactgtacagtcctctccagcccgacatcgaacagggcaagcttcagatgtgggtggacttgttccctaaagccttgggtagacctggcccaccgttcaacataacaccacgcagggcccggcgcttttttctgaggtgtatcatatggaacactagggacgtaattctggatgacctctcgctcacgggcgaaaaaatgtcagatatatacgtgaaaggttggatgattggcttcgaggaacacaagcaaaaaacagacgtgcactacaggtccctaggaggagaaggaaacttcaactggcggtttatcttcccctttgattaccttcccgccgaacaggtttgtaccatcgccaagaaggatgcattctggcgcttggacaagactgagagcaaaatacccgctagagttgtgtttcaaatttgggacaatgacaagttttcctttgacgacttcttaggtagtcttcaactggacttgaacagaatgcccaaaccagcaaaaaccgccaagaagtgtagcttggaccagttggacgacgcgttccatccagaatggttcgtaagtctgttcgagcagaagacagtgaagggctggtggccgtgcgtggcagaggagggggagaagaaaatcctggccgggaaactcgagatgaccctggaaattgttgccgaatccgaacacgaagaacgcccagccggccagggaagagacgagcctaacatgaaccctaaactcgaagacccccgaaggccggacacatcttttctgtggttcactagcccatataagaccatgaagtttatcctgtggcggaggttccggtgggccatcatattgtttatcatacttttcattttgcttctgtttctggctatttttatttacgcattccctaactacgccgcgatgaagcttgtcaagcccttctcttag

SEQ ID NO: 2479 - DNA, 6294 bp, Artificial Sequence
  Description of Artificial Sequence: Synthetic coding sequence
atgctacgagtgttcatcctgtatgctgagaacgtccatacccccgacacagatatttccgatgcctattgttcagctgtgtttgctggggtcaagaaacggacaaaagttattaagaactcggtgaatcccgtctggaacgaggggtttgaatgggacctgaaagggatcccacttgatcagggcagcgaactgcacgtagtcgttaaggatcacgaaactatggggaggaacagattcctgggggaagcaaaagtgcctctgagggaggtgctcgctaccccttccctatctgcctcctttaacgccccgctgttggataccaagaagcagccaacaggagcctcccttgtgcttcaggtgagctacaccccattgcccggcgctgtcccactgttccctcctcctaccccattggagccatctccaactctgccggatctggacgtggtggcagggggcggacagtccagggccgagacttggtccctgctgagtgattccaccatggacactcgatacagtggcaagaaatggcccgcccctacggacaccggtggggaagaggacacagaagatcagggattaacgggggatgaggcggaaccctttcttgaccagagcggtggccccggtgcaccgacaaccccaaggaagttgccgtcaaggccccctccgcattatcccggtattaagaggaagaggagcgcacccacctcccgtaagctcctttctgataagccacaggatttccaaattagggtccaggtgattgaaggtagacagctcccaggtgtgaacattaaacctgtggtgaaggtcaccgcagctggccagacaaaaagaacaaggatccacaaaggaaactctccactgttcaacgaaactctattttttaatctcttcgatagcccaggcgaacttttcgacgagccaattttcattacagtggtggatagccgctcacttagaacggacgcccttctcggagaattcagaatggacgttgggacgatctacagggaacccaggcatgcatacctgcgaaagtggcttttacttagcgacccggatgattttagcgccggcgcaaggggttaccttaagacatctctatgcgtgctggggcccggggacgaggcacctctggagcgcaaagatccatccgaagataaggaagacatagaaagcaatctgctgagacccactggcgtggctctgagaggtgcccatttctgcctgaaggtcttcagagcagaagatctgccccaaatggatgatgctgtgatggacaacgtgaaacagatcttcgggtttgagagcaacaaaaaaaacttggtggaccctttcgtagaagttagcttcgcagggaagatgctctgctccaaaattctggaaaagactgccaacccacagtggaaccagaatattaccctacccgcgatgtttccctcaatgtgtgaaaaaatgagaattagaatcatagactgggataggcttacccacaacgatatcgtggctacgacctacctgtctatgagcaaaatatctgcccctggaggagaaatcgaggtcgacgattatctaggcttcctgccaacgtttgggccctgctatatcaatctgtatggcagcccccgtgaattcactggcttcccggatccctacactgagctaaataccgggaaaggtgagggcgtggcctatagggggaggctcttattgtcgctggagaccaagttggtagagcactccgagcagaaggtcgaagatctgcccgccgacgatatattgcgcgtagaaaaatacttaaggagaagaaaatactcactctttgctgccttctattccgcaaccatgctacaggatgttgatgacgctattcagtttgaagtgtccatcgggaattacggaaataagtttgatatgacatgtctgcccctggcatcaacaacccaatactcccgcgccgtgttcgacggatgccattattactatctcccttgggggaatgtgaagccagtggtggtactaagttcctactgggaggacatttctcaccgcatcgaaacacagaatcagctgctgggcatcgcagacaggctggaggctggactcgaacaggtccaccttgctctgaaagcccagtgctctacagaagatgttgactctctggttgctcagcttacagatgagctgatcgccggttgttcacagcccttgggagacattcacgagaccccttcagcaactcatctagatcaatatctctatcagttacggacacaccatctctctcagatcacggaggctgctttggcgctcaaattaggtcatagcgagctgccagccgcgcttgaacaagccgaagactggctgctgagattaagggccctggccgaggagccacagaactctttgccagacatcgtcatatggatgttacagggggacaaacgtgtagcttaccaacgggtgcccgcccaccaagtgttgttttccagacggggggccaactactgtggcaagaactgcgggaaactgcagacgattttccttaaataccctatggagaaggttcctggcgcccggatgcccgtccagatacgagttaagttgtggtttgggttgtctgtggacgaaaaggagttcaaccagttcgctgagggaaagctgtctgtgttcgcagaaacttacgaaaatgagactaagttggctctcgtgggaaactggggtactacaggactcacctacccgaagttcagcgacgttaccggtaagatcaagctgccaaaagacagcttccgtccctctgccgggtggacatgggctggtgattggttcgtctgccctgagaagactctgctgcacgatatggacgctggccacctctccttcgtcgaagaggtttttgaaaatcagactcgcctccccggcggccagtggatatacatgagtgacaattataccgacgttaatggggaaaaagttctgcccaaagatgatatcgagtgtccattgggttggaagtgggaagacgaagagtggagtactgatcttaacagggcggtggacgaacaaggatgggagtattctatcaccatccctcccgagcgcaagcccaagcattgggtccccgcggaaaagatgtactacacacacaggaggcgtcgttgggtccggttgagacgacgggatctatcacaaatggaagctctgaaacgccacaggcaagcggaggccgagggggaagggtgggaatacgcgtccttatttggctggaagtttcacctggaatatcgcaagactgatgccttccgcagacgcaggtggcggcggcggatggaaccactggaaaagacgggacctgccgccgtgttcgcactagaaggtgctctgggtggcgttatggatgataagtccgaggactcgatgagcgtgagcacccttagttttggcgtgaataggccaacaattagttgcatcttcgactatgggaatcggtaccacttgcggtgctacatgtatcaggcacgagacctcgctgcgatggacaaagactcattttcagatccatacgccatcgtgagctttcttcaccagtcacagaaaaccgtagtggtcaagaatactctgaacccgacatgggaccagaccctcattttttacgaaatcgagatttttggggaacctgccacagtggctgagcagccaccctccatcgtggtagagttgtacgatcacgatacttatggtgccgacgagtttatgggacggtgtatatgtcagcccagtcttgagcggatgccccggctggcatggtttcctcttacgaggggcagccagccatcaggtgagctgcttgcctccttcgagctaatacagcgggagaagccggcaatccaccatataccaggcttcgaagttcaggagacgtcccggatcctggacgagtctgaggataccgatctaccctatcccccaccacagagggaagccaatatctacatggtgccacagaacataaaacccgcccttcagcggacagcgatcgagatccttgcctggggactgaggaacatgaaaagctaccagttagccaatatttcctctccaagccttgtggtggagtgcgggggacaaacagtgcagtcctgcgttattcgtaatttgcgtaaaaatccaaatttcgatatttgtactctgtttatggaagtgatgcttccacgagaggagctgtactgtccaccaatcactgtcaaggtgatcgacaatagacagtttggtcgtcgccctgtagttggacagtgtaccattcggtctctggaaagcttcttgtgtgacccatactcagccgagtcgccttccccccagggcggccctgacgatgtgagtctactgtcaccgggggaggatgtgctaatcgatatagacgacaaggagccactgatcccaatccaagaggaggagtttattgattggtggtcgaagttctttgcatctataggtgaacgtgagaagtgtggctcatacctcgaaaaggatttcgacactctgaaggtctacgacacccagctcgagaatgtggaagcatttgaaggccttagcgatttctgcaacacatttaaactctacaggggaaaaacccaagaggagaccgaggacccctccgtcatcggcgagtttaagggactatttaaaatctacccgttgcctgaagaccccgcaatccccatgcccccacgccagttccaccaactggccgctcaaggcccacaggaatgtctggtaagaatttatatagtgcgagcattcggcctccagcctaaggaccccaacggaaagtgtgacccttatattaagatcagcataggtaaaaagtctgtgtctgaccaggacaactatattccttgtacgctggagcctgtcttcggaaagatgtttgaactgacttgcactcttcctctcgagaaggacctcaagatcaccttgtatgattatgatctgctgagcaaagatgagaaaatcggggagaccgtggtggatttggagaaccggctgctttcaaagtttggcgctcgatgtggcttgcctcagacctattgcgtgtctggacccaatcagtggcgagatcagctcaggccaagccagctcctgcatctgttttgtcagcagcaccgcgtgaaggccccagtctacaggaccgatcgtgtgatgttccaggataaagaatattccattgaagagattgaagctggacggatccctaatccccacttaggccccgtggaggagaggctggctctacacgtgctccaacagcagggactggttcctgaacacgttgagtcccggccactatactccccgctgcagcctgacattgagcaaggaaaattgcaaatgtgggtggatttgttcccaaaggctctgggacgccctggaccgccatttaacataaccccccggagagcccgacgattttttttacgctgcattatctggaataccagagatgtgattctcgatgatctctctttgacaggggaaaaaatgtctgacatatacgtgaaaggctggatgattggatttgaggagcacaaacagaagacggatgtacattacagatctcttggcggcgaaggcaattttaactggaggtttatctttccctttgactacctgcctgccgaacaagtgtgcacaatcgctaagaaggacgcattctggagactggacaaaaccgagtcaaaaattccagccagagtggtgttccagatctgggacaacgataaattttcctttgatgatttcttaggcagcttgcagcttgatctgaatagaatgccaaaacccgccaagactgccaagaagtgcagtctcgatcaactggacgacgccttccatcccgagtggttcgttagcttgtttgaacagaaaacagtcaaaggatggtggccctgcgtggcggaagagggtgaaaaaaagatcctggctggcaaattagaaatgaccctggagatcgttgccgagagcgaacacgaagagcgccctgcagggcagggtagggacgagcccaatatgaatcctaagcttgaggatcccaggcggccagacacctcgttcctgtggttcacgtccccctataaaaccatgaagttcatcttgtggagacgttttagatgggctattatactgttcattattctctttatcttgctgttgttcctggcaatatttatttacgcatttcctaactacgctgccatgaagttagtgaaaccgttctcttag

SEQ ID NO: 2480 - DNA, 6360 bp, Artificial Sequence
  Description of Artificial Sequence: Synthetic coding sequence
atgctctgttgtctgctggttcgcgcatctaacctcccaagtgccaagaaggatcgccgctctgaccccgtggcatccctgacattccgcggcgttaaaaaaaggactaaagtcatcaaaaacagcgttaatccagtgtggaatgaggggtttgaatgggatttaaaggggattccactggaccaagggtctgaactacatgtcgttgtaaaagaccatgaaaccatgggtaggaaccgcttcctgggcgaagccaaggtgcccctgcgtgaagtgctggctactccgagcctatccgcgtccttcaacgcgccattgctggataccaagaagcagcccaccggagcctctctcgttctacaggtgtcctacactcctctgcctggggccgtacctctcttcccacccccaacacctcttgagccatctcccaccctacccgacctggacgtggtggctggcggaggccagagtcgcgcagagacgtggagtctgctaagcgattccacaatggacacacgctattctgggaagaaatggccggccccaacggatacggggggagaagaagacactgaggaccagggactcactggagatgaggccgaaccattcctggatcagagcgggggtccgggcgcacccactactccacgcaagttgccatcacggccgcctccccattatccggggatcaagaggaagaggtccgcacccacatcccggaagctgctttcagacaaaccacaagacttccagattagagtacaagtgatagagggtcgccagctgcctggagtgaacataaaacctgtggtgaaagtcacagctgccgggcaaacaaaacgaacacgcatccacaagggcaactcacctctgtttaatgaaacactgttcttcaatcttttcgattcacccggcgagctgtttgatgagccaattttcataacagtggtggactccagatccttgaggaccgatgctctccttggggaattcaggatggatgtgggaacgatctatagagaaccccggcatgcctacctgcgcaagtggctgctccttagcgaccccgacgatttcagcgctggtgctcgaggatacttaaaaacgtccctctgcgtgttgggccctggcgacgaagcccccttggaaaggaaggaccctagtgaggacaaggaggacattgaatctaatttgctccgcccaactggcgttgctcttcgcggcgcacatttctgcctcaaggtgtttcgggccgaggatttgccacagatggatgatgccgtgatggacaatgtcaagcagattttcgggttcgagtctaataaaaagaaccttgtcgatccatttgtggaagtctcttttgctggtaaaatgttgtgctccaagattttagagaagacggcaaacccccagtggaaccagaatatcaccctccccgctatgttcccttccatgtgcgagaagatgaggattagaattatagattgggaccgtctgacccataatgatattgtggcaacaacatacttaagcatgagcaagatcagcgcacctggcggagaaattgaagttgacgactacttaggctttcttccaacattcggaccatgctacataaacttatacgggtctcctcgtgagttcacaggctttcctgacccgtatacagagctgaacaccggaaaaggagagggggttgcatatagagggcgactgttactgtctctggagacgaagcttgtggaacactcagaacaaaaagtggaagacttacccgctgacgatatcttacgcgtcgagaaataccttcgaaggcgaaaatattcactcttcgctgcgttctactctgctaccatgctgcaggacgttgatgatgctattcaatttgaggtgagtatagggaactatggcaataaattcgatatgacgtgccttccgctcgccagcaccactcagtatagccgtgccgtcttcgatggctgtcactactactacttgccctgggggaatgttaagccagtggtggtgctctctagttattgggaagacatcagccatcggatcgagacgcaaaatcagctgctcggcatcgctgacaggttagaagctggtcttgaacaggtgcacttagcccttaaggcgcagtgttcgaccgaagacgtggatagtcttgtggcccagcttacagatgaacttatcgccggctgctcgcagcccctgggagacatccacgagacgcccagcgctacccacctggatcagtacttatatcagctaagaacacaccacttaagccagatcactgaagccgccctggctcttaagctggggcatagcgagctgcctgcagcactcgagcaggcagaagattggttgttgagactgcgggccctcgctgaggaacctcagaactctttgccggatattgtgatctggatgcttcagggcgacaagagagtggcctatcagcgtgtccctgcccaccaggtgctgttttctcggcgtggggccaactactgtggcaagaattgtggaaaattacaaacgatttttttaaagtaccctatggaaaaggtgcccggagcaagaatgcctgtccagatccgcgtgaagctttggtttgggctctccgtggacgagaaagagttcaatcaattcgccgaaggaaagctcagcgtctttgcagagacttatgagaacgaaaccaagctggctttagtaggcaactggggcactacgggtctcacctaccccaagttttccgacgtcacgggtaaaatcaagctgcccaaggattcattccgtcctagtgctggctggacttgggccggggattggtttgtctgtcctgagaagactctactgcatgatatggacgcaggtcatctgagtttcgtagaggaggtgttcgagaatcagactcgtctaccgggaggtcagtggatttatatgtcagacaactatacggacgtaaacggagagaaagtgcttccaaaggacgatatagagtgcccactcggttggaagtgggaggacgaagaatggagcacggatttgaatcgcgctgtggacgagcaggggtgggaatattctattaccataccccccgaacggaaacctaagcactgggttcccgcagaaaagatgtattacacgcaccgccgtcgcagatgggtgcggctacgcaggagggacctatcccagatggaggccctgaaacggcacaggcaggccgaggcggagggagaagggtgggagtacgcctctcttttcggttggaagtttcaccttgagtatcggaaaaccgatgcatttagacggagaaggtggcgccgtaggatggagcccctggagaaaactgggcccgccgctgtgttcgccctggaaggagccttaggcggagtgatggacgataagagcgaagacagcatgtctgtatccacattaagctttggtgttaacagacccacaatttcatgcatttttgactacggaaaccggtatcatctgcgctgctacatgtatcaggcacgcgacctggccgcaatggacaaagattctttctctgacccatatgccatcgtatcctttctgcaccaatcacaaaagacggtcgtggtgaaaaacaccctcaaccccacttgggaccagacacttattttttacgaaatcgaaattttcggggaaccggcaacagtggctgagcagcctccttcaatagtagtggagctatacgatcatgacacatatggggcagacgaatttatgggccggtgcatttgccagccttctctggaacggatgccgagattggcttggtttcccttgaccaggggctcccagccttcaggagaactgcttgcctcattcgagttgatacagagggaaaaaccagccattcaccacattccaggtttcgaggtacaggaaacctcgcgaatccttgacgagagcgaagacaccgacctgccctacccccccccacagagggaggccaatatctacatggtgcctcagaacattaaacctgccttgcagaggacggcaatagagatactggcctggggcctaaggaatatgaaatcgtatcagctggctaatatctcctccccctcactggtggtagagtgcggaggtcagaccgtgcagagctgcgtcatacggaacctcaggaaaaacccaaattttgacatatgtacgctttttatggaagtaatgcttcctagggaggagctatattgtccccccattaccgtcaaagtcattgacaatcggcagtttggccgcaggccagtcgtggggcaatgcacaattagaagcctggagagctttctgtgcgatccgtactcagctgagtcaccatcaccacaggggggacctgacgacgtgtcactgctgtcacctggcgaggacgtcctgatcgatattgatgacaaagaaccactcatcccaatccagttggcggacggactgagctccctggccccgacaaataccgcttctccaccctctagccctcacgaggaagaatttatagattggtggtccaagttctttgcatctattggggagcgagaaaaatgcggctcttatctggagaaggacttcgatacgctgaaggtgtacgacacacagctggagaacgttgaggcattcgaggggctgtccgacttctgtaatacatttaagctctaccggggtaaaacacaggaagaaaccgaggatccctcggtgataggagaattcaaagggctgtttaagatctatccgcttcccgaggaccccgccatccccatgcctcctcgacagttccaccaactggccgctcagggaccacaagagtgcctagtgcggatctacatcgtccgagcgtttggtttgcagccaaaggatcctaacgggaaatgtgatccttatattaaaatcagcatcggtaaaaagtctgtatcagatcaggacaactacatcccctgcactctcgaacccgtgttcggaaaaatgttcgagctgacctgcacactccctctggaaaaagatctgaagattactctttatgactacgacttgctgagcaaagacgagaagatcggagaaacagtcgtagatcttgagaataggctactgagtaagtttggagctcgatgtggcttgccccagacatactgcgtttcaggtcccaatcagtggcgggaccagttgagacctagccagctactacacctcttttgccagcaacatcgagtgaaagcccccgtttatcgaactgacagggtgatgtttcaggacaaggagtacagtattgaggaaatcgaagcaggtaggatacccaacccacaccttggccccgtggaagagagacttgcattgcacgtgctgcaacagcagggcttggtgcccgagcacgttgaatctcggccattatacagcccattgcagcccgacatcgaacaggggaagttacaaatgtgggtcgacctgtttcccaaggcactcggtaggcccggacctccatttaatattactcctcggcgggctaggcgcttctttttgaggtgtatcatttggaatacccgggacgtcatccttgacgacctctccctcaccggcgagaaaatgtccgatatttacgttaagggttggatgatagggttcgaggagcataagcagaagactgacgttcactacaggtctctcgggggagaaggcaacttcaattggcgctttatcttcccctttgattacctaccagctgaacaagtttgtacaatcgctaaaaaggatgcattttggagacttgacaagaccgagtcaaaaataccagcccgagtggtttttcagatatgggacaacgataagttttcatttgatgacttcctggggtctctccagcttgatctaaacagaatgcccaagccagccaagaccgccaaaaaatgtagcttagaccagctggatgacgcctttcatcccgagtggttcgtctctctgtttgaacagaagacagttaagggctggtggccatgtgtggctgaagagggggagaagaagatacttgccggcaaactggagatgacgcttgagatagttgcagagtccgagcatgaagaacgtcccgccggtcaaggcagggatgagccgaacatgaatccgaagctggaggaccccaggcggcccgacaccagctttctgtggttcacatctccttataaaactatgaagtttatcttgtggcgccggtttaggtgggccatcatcttgttcattattcttttcattctgctgctgtttctggcaatctttatatacgcgtttccgaattatgccgctatgaagttagttaaaccatttagttag

SEQ ID NO: 2481 - DNA, 6297 bp, Artificial Sequence
  Description of Artificial Sequence: Synthetic coding sequence
atgctctgctgcctgctagttagagcctccaatttgccgtcagccaagaaagaccgtcgcagtgacccggtggcatccctgacattcaggggagtaaagaaacggactaaggttattaagaatagtgtgaacccagtgtggaatgaaggatttgagtgggatctgaaaggaatacccctagatcaggggagtgagctgcatgtggtggtgaaagaccatgaaaccatgggtcgcaatcgcttcctgggggaggcaaaagtgcctctacgggaggtcctggctaccccatctctgtccgcaagttttaatgcccctcttcttgatacgaaaaagcagccaaccggcgcatcgttggttctgcaagtatcttatacacctttgccgggggctgtcccgctatttcccccacctacaccactggaaccatcccctaccttgcccgacctggatgtcgtggcaggcggcgggcagagtagggctgaaacctggagtctgctttcagactctacaatggatacgaggtatagtggcaaaaaatggcctgctcccaccgacaccggaggagaggaagacaccgaagaccagggcttgacgggggacgaagccgagcccttcctggaccagtctggcggccctggggctccaaccacccccaggaagctaccctctaggccccctccacactatcccgggatcaaaaggaaaagatcggcacccacttcccgtaagcttctgagcgacaaaccacaagacttccaaatcagggttcaagtgatcgaaggccgccagttaccgggagtgaatatcaaacccgtcgtgaaggtgacagcagcaggacagaccaaacggacgcggattcacaaaggaaactctccactgtttaacgagacactgttttttaacctgttcgatagcccgggtgaattattcgatgaacctatttttatcactgttgtggactcaagatccctgagaaccgacgcacttttaggtgagttcaggatggacgtgggtaccatataccgcgagcctcgtcacgcgtatttgcggaaatggttgttgttgagcgaccctgatgacttctctgctggggctcgggggtacctgaagacatcactgtgtgtcctgggcccaggggacgaagctccgctggaacgtaaggacccttccgaggacaaagaggacatcgaatcaaatctgctccggccaactggcgtggctttacgcggcgcccatttctgcttaaaagtgtttcgcgcagaggatctgccgcaaatggatgatgccgtcatggataatgtgaaacagatatttggatttgaatcgaacaaaaagaacctagtggacccttttgtcgaagtgtcttttgctggtaagatgctgtgcagtaaaatcctcgagaaaacagccaacccacagtggaatcagaacataactttgcctgctatgttcccctcaatgtgcgaaaagatgaggattaggatcatcgactgggacagactgacgcacaatgacatagtggcgactacctacttgagcatgtctaagattagcgctccaggaggagaaattgaggttgatgattatttgggtttcttgcccaccttcggcccttgctacattaacctgtacggctccccaagggaattcaccgggttcccagatccttatacagaactgaatacggggaaaggagaaggcgtagcctaccggggcaggctgctgctgtcactcgaaaccaaactggtggagcacagcgaacagaaagtggaagatctccccgccgacgatattttgcgggtagagaagtaccttcgtaggagaaaatactccctgttcgccgcattctattcggctaccatgctgcaggacgtagacgatgccatccagttcgaagtgtctattggcaactacggtaacaagtttgacatgacgtgcctccctctggcgtccaccacgcagtacagtcgggcggtatttgacggttgtcattactattatttaccatggggtaatgtaaagccagttgtcgtgctgtcctcttactgggaagatattagtcaccgcattgaaacccagaaccaactccttgggatcgccgacaggttagaagctggattggagcaggtgcacctcgcgctgaaggcccagtgttcaacagaggatgtggactctctggttgcccaacttacggacgagcttatcgcagggtgcagtcagcccctgggcgacattcacgaaaccccttcagccacgcatctggaccagtatctgtatcagctccgcacccaccacctgtctcagattactgaggcagccctggccttaaagttgggacattcagaacttcccgccgccttggagcaagccgaggactggctgttgcggctgcgggcgctcgctgaggagcctcagaattctctccctgacattgtcatctggatgttgcagggggacaagagagtggcctatcaaagagtccctgcacaccaagtgttgttcagcaggcggggggccaattactgtggcaaaaactgcggcaagctgcagacaatctttcttaagtaccccatggagaaagtcccaggggcaagaatgcccgttcagatcagagttaagttatggttcggactctctgtagacgaaaaggagttcaatcagttcgctgaaggtaaactgagtgtgttcgcagagacctacgagaacgagactaaacttgccctggtgggaaattgggggactactgggctcacctacccaaagttttccgatgtgaccggcaaaatcaaactgccaaaagattctttcaggccctcagccggctggacctgggccggggactggtttgtgtgcccagaaaaaacattactgcatgatatggacgccggccatttatcttttgtcgaggaggtgttcgagaaccagacaagactccctggcgggcagtggatatacatgagcgataattatactgacgtaaatggtgagaaggtcctgcccaaggacgacattgaatgtccgttgggctggaagtgggaggatgaggagtggagcacggacttgaaccgcgcagtggatgagcagggctgggaatattcgattaccatccctccagagagaaagccaaagcactgggtacctgctgaaaagatgtactacacgcaccgccggcgaaggtgggtcaggctcagacgcagggatctgagtcagatggaagcactgaaaaggcacaggcaggccgaagctgagggagagggttgggaatacgcctcactgttcggttggaagttccacctcgaatacaggaaaaccgatgcattccgccgacgcagatggagacgccgcatggaacccttagaaaagaccggccccgcagcagtgtttgccctcgagggagcgctcgggggagtgatggacgacaagtccgaagactccatgtcagtgtctactctgtcctttggtgtgaaccggccgaccatttcatgcatcttcgattatggaaataggtatcatttgcgttgttacatgtatcaagctcgggatctcgccgcaatggacaaagatagttttagcgatccgtacgcaatcgtgagttttctgcaccagtcacagaaaacagtggtcgtaaaaaatactctcaaccccacttgggatcagacacttatattttacgaaatcgagatttttggggagccggcaacagtggccgaacagccgccttccatcgtagtggaactttatgatcacgatacatacggcgcggatgagttcatgggccgatgcatctgccagccctcacttgaaagaatgcctagactagcatggttcccattgacgcggggcagccagcctagcggcgagctgctcgcaagcttcgagttgatccagagggaaaagccagcaattcaccatatcccaggatttgaggtgcaagagacttccagaatcctggacgaatctgaggataccgacttgccttatccccctccacagagggaagcgaatatctacatggtgccccaaaacataaagcctgccctgcagaggaccgccatagagatcttggcttgggggcttagaaacatgaaaagttaccaacttgccaacatctctagcccttctcttgtcgtggaatgtggaggacagacggtccagtcttgcgttataaggaacctgcgcaaaaatcctaattttgatatctgcacgcttttcatggaagtgatgctaccgcgcgaggagctctactgccctcccattaccgtaaaagtaattgacaatcgccagttcggccgacggccagtggtgggccagtgtaccatccgctccctcgaatcatttttatgcgacccctatagtgctgagagtccatccccacagggggggccagatgacgtcagcctgttaagccccggagaggacgtcctgatcgatatcgatgacaaagagccgcttattcctatccaggaagaggagtttatcgactggtggagtaaattcttcgcatccattggagagcgcgagaaatgtggatcttatctggagaaggattttgataccttaaaggtgtatgacacccagcttgagaatgtggaagctttcgaggggctgtctgacttctgcaacacattcaaactttacagagggaagacccaggaggagacagaggatccatccgtgattggcgaatttaaggggttgttcaaaatctaccccttgcccgaagatcccgccataccaatgccacctaggcagtttcatcagctcgcagctcagggtccccaggaatgtctcgttcggatctacatcgtgagggccttcgggctgcagcccaaagaccctaacgggaaatgtgatccctatatcaagatctccattgggaaaaagtctgtgtccgatcaggacaactatattccatgcaccctggagccagtattcgggaaaatgttcgaactgacctgcacacttccgcttgaaaaggacctgaagattactctctatgactacgatcttttaagcaaagacgaaaagattggcgagactgtcgtggaccttgagaaccgactgctatccaaattcggtgccaggtgtggcctgcctcagacctactgcgtgtcaggccctaaccagtggcgcgaccagttaaggccttcgcagttgctgcacctgttttgccagcagcacagagtcaaagcccctgtatacagaaccgacagagttatgttccaggataaagagtatagcattgaggagattgaagccgggcgcatccctaacccacatctgggcccagtggaagagcgacttgccctacatgtgttacaacagcagggccttgtcccagagcatgtggagtctaggccactgtactcacccctgcagccggacatcgagcagggaaaactgcagatgtgggtggacctgttccctaaagcgctgggtaggcctgggccaccctttaatattactcctaggagggcacgccggttcttccttcgatgcatcatctggaacacaagggacgtgatactggacgacctgagccttaccggcgaaaaaatgtcagacatctacgtcaaggggtggatgatcggctttgaggagcataagcagaagactgacgttcactatcgctctcttggtggcgagggcaactttaactggaggttcatctttcctttcgactaccttcccgctgaacaggtgtgtacaatcgccaagaaagatgccttctggcggttagacaagaccgaaagtaagatccctgcccgagtcgttttccagatatgggataacgacaagtttagtttcgatgactttctgggaagcctgcagctggacctaaacagaatgccaaaaccagcaaaaacggccaaaaagtgcagcctagatcagttggacgatgctttccaccccgagtggtttgtatctctgttcgagcagaagacagtcaaaggctggtggccatgtgtggccgaggaaggagagaaaaaaatcttagccggcaagttagagatgacgcttgaaattgttgccgaaagcgagcacgaggagcggccagccggccagggacgagatgaacccaacatgaatccaaagcttgaggacccacgacggcctgataccagcttcttatggtttacttctccctataagaccatgaagttcatcctttggcgtaggttccgatgggcaatcatcctctttataatcctgtttattttactgttgttcctggccatctttatctatgcctttcctaactacgctgctatgaagctggtcaagcctttctcctag

SEQ ID NO: 2482 - DNA, 6336 bp, Artificial Sequence
  Description of Artificial Sequence: Synthetic coding sequence
atgttgcgagtgttcatcctatatgctgagaacgtacatactcccgataccgacataagcgatgcctactgctctgccgtctttgcgggtgtgaaaaaacgaacgaaagtgatcaaaaatagcgtgaaccccgtctggaacgagggtttcgaatgggacttaaagggaattcctctagatcaaggctctgagctgcatgttgtcgttaaagaccacgagacaatgggtagaaataggtttcttggtgaagcaaaggtccccctgcgcgaggtcctggccaccccctccctctcagcttccttcaatgctccattgctcgacaccaaaaaacagcctacgggagcaagcctggtgttacaggtcagttacacacctctgccgggagctgtgccgctctttccgccgcctacccctttggagccctctcccacgttgcccgatctggacgtggttgccggcggcgggcaatcccgcgccgaaacatggtcccttctttccgatagcactatggacacacgttacagcgggaagaaatggccagctcctaccgacactggtggtgaagaagacaccgaagatcagggactcactggcgatgaagctgagcccttcctggaccagtcgggtgggcctggcgcgcctacgactccccggaagctgccgtcccggcccccccctcattacccaggcatcaagaggaaacgcagcgcacctacctctagaaaactcctctcagacaaaccccaagatttccagattagagtccaggtcattgaggggagacagctccctggtgtgaatattaagcccgtagtaaaagtgacagctgcaggccagacaaaaagaacccggatccacaaaggaaactctccgctcttcaatgagacactgttcttcaatttatttgatagccccggcgagctgtttgacgagcccattttcattaccgtggtagactccaggtcattgagaaccgatgctttgctcggcgaatttaggatggacgtcggcacgatttatcgggaacctcggcacgcctaccttcgcaagtggctgcttctgtctgaccctgacgacttttcagccggcgctcgcgggtatttaaaaacctcactgtgcgtgctcgggcctggggatgaagctcctctcgaaagaaaggacccctccgaggacaaggaagacatcgagagtaatctgctaagaccaaccggtgtggctctgcggggcgcacacttctgcttgaaggtgttccgcgctgaggacttgccacagatggacgatgccgtaatggataacgtgaagcagatcttcggcttcgaaagtaataagaaaaacctggtggatccatttgtggaggtttcctttgccggaaagatgctgtgcagcaagattctcgagaagacagcaaaccctcagtggaaccagaatattactcttcctgccatgtttcctagcatgtgcgaaaagatgcggattcgaatcatcgactgggacagactgacccacaacgacattgtggccacaacatatctttcgatgagcaagatctcagcaccaggcggcgagatcgaggaggagccggcaggggcagtgaaaccaagtaaggcaagcgacctggatgactatctggggtttttgcctacattcggcccatgctacattaatctgtatgggtctccaagagaattcacaggctttcccgatccatacacagagctgaacactggcaaaggcgaaggtgtcgcctaccgcggcaggttactgctctccttagaaacgaaactcgtcgaacactctgagcaaaaagtcgaagatcttccagccgatgacatcctgagagtggaaaaataccttcgacggagaaaatatagcctcttcgctgccttttactcagccactatgctgcaagatgtggacgatgcaatccaattcgaggtaagcatcggcaactacggcaacaagtttgatatgacgtgcttacccctcgcctctacgacgcagtactccagggctgttttcgacgggtgccactactattatcttccctggggcaacgtgaaacccgtagttgttcttagttcttactgggaagatatctctcacaggattgagacgcaaaatcaattattggggatcgccgatcgccttgaggccggcctggaacaggtccacctggccctgaaagcacagtgtagtactgaggacgttgacagcctggtagcgcaactcactgatgagctgattgcgggatgttcacagcccctgggggatatccatgagacgccttcagccactcacctggaccagtatctttaccaattaaggacccaccacctttctcaaattaccgaagctgcgctggcactgaagcttgggcattccgagctacctgctgcactcgaacaggccgaggactggctgctgaggctgcgagccctggccgaagaacctcaaaatagcctcccagacattgttatttggatgctgcaaggggacaagagggtagcctaccaaagagtgcctgcccaccaagttttattttcccgtagaggggctaactactgtggcaaaaattgtggtaaattgcagactattttcctgaaatatccgatggagaaggtgcccggtgccagaatgcccgttcagattcgagttaaattgtggtttggcctttccgtcgacgagaaggaatttaatcagtttgcagaagggaaactgtccgtgttcgccgaaacttacgaaaacgaaactaagctagcgctggtgggtaactggggcaccaccgggctcacatacccaaaattctcagacgtgactgggaaaattaaactgcctaaggacagcttcaggcctagcgccggctggacatgggctggcgactggtttgtctgtccagaaaaaaccctgttacacgacatggacgcaggccatctgagctttgtggaagaggtgtttgagaatcaaacaagactgccgggcggccagtggatatacatgtcagataattacaccgacgtcaacggagagaaggtcctgccaaaggatgacatagagtgcccgctgggatggaaatgggaagatgaagaatggagcacagacctgaatagagcggtcgatgagcaaggatgggagtactccatcactatccccccagaaaggaaacccaagcattgggttcccgcggaaaagatgtactatacccaccgcagaaggagatgggtaaggcttagacgccgggatctcagtcaaatggaggctttgaaaaggcaccgtcaggcagaagctgaaggcgagggatgggaatatgcctcactgtttgggtggaaatttcatttagagtaccgcaagactgatgcattccggagacggagatggcgccgtcgcatggaacctctagagaagacaggtcctgccgctgtgtttgccttagaaggcgcactcgggggggttatggatgataaatccgaggatagcatgagcgtttccactctgagcttcggcgttaatagaccaaccatctcatgcatttttgactacggcaaccggtaccacctccggtgctacatgtaccaagctagagacctggctgctatggacaaagatagcttctctgatccttacgctattgtgagctttctgcatcaatctcagaaaacagtggtcgttaagaatacactgaacccgacctgggaccagacactcatcttctatgaaattgagatcttcggagaacctgccacggttgccgaacagccccctagtattgtggtggaactgtacgatcatgatacttatggcgcggatgagttcatgggacggtgcatctgccagccctccctagaaagaatgccgagactggcgtggttcccgctgacacgcggatctcagcccagcggggaactgttagcttcgttcgagctaatccagcgcgagaaacccgccattcaccatattcccgggtttgaggtccaggagaccagccggatcctcgatgaaagtgaggatacagacctgccgtatccccccccgcagagagaggccaatatctatatggtacctcaaaacataaaacccgccctccagaggaccgccatcgaaatattagcttgggggctgcggaacatgaagtcttaccaactcgccaacatctcaagcccatctcttgtggtggagtgtggcggacaaacggtgcagagttgcgtgataaggaaccttaggaaaaaccccaatttcgacatttgcacactgttcatggaagtgatgctgccccgtgaagaactttactgtcctcctatcacagtgaaagtcatcgacaatcgtcagttcggacgccgccctgtcgtcggacagtgtacgatccgatcgctcgagtccttcctgtgtgatccctactcagccgaaagcccgtccccccaagggggccccgacgacgtgtcgctcttgtcccccggcgaagatgtcctaatcgacattgacgataaagagccacttatacctatacaggaagaggaattcattgactggtggagcaagttcttcgcttctattggcgagagagagaaatgcggcagctaccttgagaaggacttcgatactctgaaagtatatgatacacagctcgagaacgttgaggcgtttgaaggcctgtctgatttttgcaacacattcaagctttacagggggaagacccaagaggagaccgaggatccctctgtaatcggagagtttaagggcctttttaaaatatacccccttcctgaagaccccgccattccgatgcctccccggcagtttcaccaactagctgcccagggaccccaggaatgtctggttcggatttacatagtgagggcttttgggcttcaacccaaagaccccaatggcaagtgtgatccatatataaagataagtatcgggaagaagtctgtgtcagaccaagataattatataccttgcaccttggaacccgtgttcggtaagatgttcgagctcacatgcactttgccccttgaaaaggatctgaaaatcacactctatgattacgatctgttgtctaaggacgagaaaattggtgagaccgtcgtggatttggagaaccggctgttatccaagttcggagctaggtgtggcctgccacaaacatactgcgtgagcggtccgaatcagtggcgagatcagctccgaccatcccagctgttacatctgttttgccagcagcacagagtgaaagccccagtatacaggacggaccgagtaatgttccaggataaggagtactcaatcgaagagatcgaggcgggcagaattcccaacccgcatttagggccagtggaagaacggctagctctgcatgtcctgcagcagcagggcttggtgcccgagcatgtcgaatctcggcccctctactcacctcttcagcccgatattgaacaggggaagctacaaatgtgggtcgacctgttccccaaggccctcggtaggccaggcccgccctttaatataacgccccgtcgcgcccgcagattctttttaaggtgtataatctggaacacacgggacgtgatcctggatgacttatcacttactggcgagaaaatgtctgacatctatgtgaagggatggatgatcggatttgaagaacacaagcagaagaccgatgtgcactaccgcagtcttggcggagaaggcaacttcaattggcgattcatcttccctttcgattacctgcccgctgagcaggtctgcactatcgccaagaaggatgcattttggcggctcgataagaccgagtcaaaaatacccgctagagtggtgttccagatctgggacaacgacaaattctccttcgatgattttttaggctccctgcagcttgacctcaaccgcatgcctaaaccggcgaaaaccgccaagaaatgcagcttggaccagctggatgacgcatttcaccccgagtggtttgtgtccctcttcgagcaaaagacagttaagggttggtggccttgtgtggccgaagagggcgagaagaagatcctggctggcaaacttgaaatgaccctggagattgtggctgagtcagagcacgaggaacgtccagctggacaggggcgggatgagcctaatatgaatccaaaactggaagacccgcgcaggccagatactagctttctgtggtttacatctccgtataaaacaatgaagttcattttgtggcgtcgattccggtgggcgattattctgttcattattttgttcattctgcttttgtttctggctattttcatctacgctttcccgaattacgcagccatgaagctggtgaagccctttagctag

SEQ ID NO: 2483 - DNA, 6306 bp, Artificial Sequence
  Description of Artificial Sequence: Synthetic coding sequence
atgctcagagtgtttattctgtatgccgaaaacgtccacaccccagataccgacatctcagatgcctattgttcagcagttttcgccggagtaaagaagaggaccaaagtcatcaagaatagtgtcaacccagtgtggaacgaggggtttgagtgggatctgaagggcattccgctggatcagggatccgagctccacgtagtggtgaaagaccacgaaaccatgggcaggaatcgtttccttggcgaggcaaaagtcccactcagggaagtcttggccaccccatcactgtccgcaagcttcaatgccccgctactcgatactaaaaagcagccaacgggtgcctccctagtgctccaggtatcctacacccctctccccggcgctgtaccactcttcccccctcccactcctctggagcccagccctacccttcctgatctcgacgtcgtagctgacaccggcggagaggaggacacagaggaccaggggctgacgggtgacgaagctgaaccctttttggatcagagcggggggccaggcgcaccgacgactccccggaaactgccatcacgtcctcccccccactatccgggcatcaaacgtaaacgctccgccccaaccagccggaaactgctatccgacaagccgcaggactttcagatacgggtgcaggttatcgaaggccgccagctacccggcgtcaacattaagccggtggtcaaggtgaccgccgcaggacagacaaaacggactcgaatccataagggcaattctccgctgttcaacgagactttgtttttcaacctcttcgactcccctggggagctatttgacgagccaatcttcattacagtggtggactcaaggtcccttcggactgatgcgctattgggcgaattcagaatggatgtgggtaccatctaccgggaacctcgccacgcctacctgaggaaatggctcctcttgtccgacccagacgacttttctgcgggagcacgcggctacctgaagactagcctgtgcgtgttggggcctggagatgaggcgccactggagcggaaggatccgtcagaggacaaggaggacattgaatctaacctgctgcgacccacaggggtagcattgagaggtgcacatttctgcctgaaggtatttagagccgaggatctgccacagatggatgatgccgttatggataatgtgaaacagatcttcgggttcgagagtaacaagaagaacctagtggacccttttgtagaggtgagcttcgctggtaagatgctgtgctctaaaattctggagaagacagccaacccgcagtggaaccagaatatcaccctcccagcaatgtttccgtcgatgtgcgagaagatgaggattcggattatcgactgggaccggttgacacacaatgacatagtggccaccacctatctgtctatgtcaaagattagcgcacctggtggggagattgaggaggaacccgccggcgctgtgaagccctcaaaagccagtgatctcgatgactatctcggtttcctgcccactttcggcccctgctatatcaacctgtatggtagcccccgtgagttcactggctttcctgatccatatacagagctcaacacagggaaaggcgagggcgttgcttaccgtggccgactactgctctcactggagacgaaattggtcgaacattctgaacaaaaggtggaggacctgcctgctgatgatatcttgcgcgtggaaaagtatttaaggcggcgcaagtactctcttttcgctgctttctattcggcaacaatgctgcaagatgtggatgacgctattcagttcgaggtcagcatcgggaattacgggaataagttcgacatgacctgtctgccgctcgctagcaccactcaatattccagagccgtcttcgatggctgtcattattattaccttccctggggcaacgttaagccggtcgtggtgctcagtagctactgggaagatatcagtcatcggatcgagactcagaatcaactcttaggcatcgctgacaggttggaagctggacttgagcaggtacacttagcattgaaagctcaatgtagcacagaggacgtggattccttggttgcacaactgacagatgagttaatcgccggctgctcccagcccctgggagacattcatgagacccccagcgctacacatttggaccagtacctgtaccagctgaggactcaccatctgagtcagataaccgaagctgctttagcgctaaaacttggccacagcgaactacccgcagcactcgagcaggcagaggactggcttctgcgcctcagggccctcgcggaggaaccccaaaattcactgcccgacatcgtaatttggatgttgcaaggagacaagagagtcgcctaccagcgagtgcccgcccatcaagtactgttcagccgtcggggtgccaactattgcgggaagaactgtggaaagctgcaaacaatctttctcaagtatcctatggaaaaggtacccggcgctcggatgcctgtccagatcagagtcaaattgtggttcggcctgtccgtggacgagaaagaatttaatcagtttgctgaggggaaactgtcagttttcgcagagacctacgaaaacgagaccaagctcgcactcgtcggcaactggggtacgactggccttacctacccaaaatttagcgatgtgactggaaagattaagctgccaaaggattccttcaggccatctgctggctggacatgggcgggcgattggttcgtgtgcccggaaaaaactctgctacatgatatggacgcgggacacctcagtttcgtggaagaggtgtttgaaaatcaaacccgcttgcctggcgggcagtggatttatatgtccgataattataccgacgtgaacggtgagaaggtcctacccaaggacgacattgagtgccccctaggctggaagtgggaggacgaggaatggagcacagatctgaaccgggccgtggacgaacagggttgggagtactccatcaccattcctcctgagcgaaagccgaaacactgggtgccggcagaaaagatgtattatactcacagacggcgtcgatgggtgcgcttgagaaggcgggacctgagccagatggaggctttgaaacggcaccgccaggctgaggctgagggagagggatgggagtacgcatcgctattcggatggaaattccaccttgagtacagaaagaccgacgcctttcgaagacgacggtggcgccgcagaatggaacctctcgagaagacagggcccgccgctgtgttcgcactggaaggcgcattaggcggagtgatggacgataaatcggaggactccatgtctgtctctacattgtccttcggagtgaacaggcctactatcagttgcattttcgattacggcaatcggtatcacctacgttgctacatgtatcaagctcgggatctcgctgctatggacaaggattcttttagcgatccatacgctatcgtgagcttcctgcaccaatcgcagaaaaccgtggtcgtgaaaaataccctcaacccaacttgggaccagactctcatcttttatgagatcgagatcttcggggaacctgccactgtcgccgaacagccgccgagtatcgtggtcgagctatacgaccacgacacttatggcgctgacgagtttatgggccgctgtatttgccagccttccctagagcgtatgccacgactggcgtggttcccactgactagaggttcccagcccagcggcgaattacttgccagcttcgaactgattcagcgtgagaagccagccattcatcacatacctggatttgaggtgcaagagaccagccgtatcttggacgaaagtgaggatacagatctcccttaccccccccctcaacgagaggcaaacatctacatggtgccacaaaatatcaagccggcattgcagaggactgctatcgaaatccttgcttgggggctgcgcaatatgaaatcgtatcagctagctaacatttcatccccatctctggtggtggagtgcggagggcagacggtgcagtcatgtgttattcgcaatctgaggaaaaacccaaatttcgacatttgcaccctgtttatggaggtgatgctcccgcgggaggaactatattgcccccccatcacagtgaaggttatcgataacagacagtttgggcgtcggccagtcgtgggtcagtgcactatccgatctcttgaatcctttctgtgcgatccgtattcagccgagtcaccaagtccccagggtggccctgacgatgtgagcctcctgagccccggagaggatgtcctcatcgacatcgatgataaggaaccactcattccaattcagctagctgatggcctgtctagcctagcgccaacgaacacggcctctcccccttctagcccccatgaagaagaatttattgactggtggagcaagttttttgcctctataggagagcgcgagaagtgcggcagctaccttgaaaaagactttgataccctcaaagtgtatgacacccaattagaaaacgttgaggcattcgagggactcagcgatttttgcaatacatttaagctctacaggggcaagacccaggaagaaaccgaggacccctctgtgattggagagttcaaaggccttttcaaaatctatccactgcccgaggatccggcaattcccatgcccccaaggcaattccatcaacttgctgctcagggccctcaggagtgtctggtgcgcatctatatcgttcgcgcattcggccttcagcccaaagacccaaatggtaaatgtgatccgtacattaaaatctcaatcgggaagaagagcgtgtcggaccaagataattacatcccttgcacgttagagccagtgttcggaaaaatgtttgaactgacgtgcacgctgcccctggaaaaggatcttaagattactctgtatgattacgacttgctgagcaaggacgagaaaatcggcgagacagtcgtcgacctcgagaacaggcttctttctaagttcggcgcgcgatgcggcctcccacagacttattgcgtgtcagggcccaatcagtggcgcgatcagctgcgtccatcccagctgttgcaccttttttgtcagcaacacagagtgaaagcccccgtctaccggaccgatcgcgttatgtttcaggataaggaatactccatcgaggagatcgaggcaggacgcatccctaaccctcacttaggaccagtggaggaacgactggctttgcacgtcctgcagcagcagggcctggtcccggagcacgtcgagtctcgtcctctatactcaccccttcagcccgacatagagcagggaaaactgcaaatgtgggtcgacctcttcccgaaggccttaggacgacccggacctccatttaacatcactccacgaagagctagacgcttctttctgaggtgcatcatctggaacacccgagacgtgattctggacgacttgtccctgaccggagagaagatgtcagacatatacgtaaagggctggatgatcggcttcgaggagcataagcagaaaaccgatgttcactataggtcccttggaggggagggtaatttcaactggaggtttatctttcctttcgattacctgcccgcagaacaagtatgcactatcgcgaagaaagacgcattttggaggttggataagacggaatccaagatccctgctcgagtagtgtttcagatatgggataacgacaagttctccttcgatgactttctcggttcattacagctggaccttaaccgcatgccaaagccagcaaagactgcaaagaaatgctctttggaccagctggacgatgccttccatccagagtggttcgtgagtctgtttgaacagaagactgtgaaaggatggtggccgtgcgtcgctgaggaaggggaaaagaagatcctggctggcaaactggaaatgactctcgaaattgtggccgagtctgaacacgaagaacgcccagctggacagggcagggacgagcctaatatgaacccaaagcttgaggatcctcgtaggcccgacacctccttcctttggtttacaagcccatacaaaactatgaagtttatcttgtggcgacgattcagatgggctatcattctgtttattatattgttcattctgctcttgtttctggccatatttatttacgcgttccctaattatgccgccatgaaactcgtcaaacccttttcctag

SEQ ID NO: 2484 - DNA, 447 bp, Artificial Sequence
  Description of Artificial Sequence: Synthetic coding sequence
atgggctatcctgaggtggaacgcagggagctcctcccggccgcagctcctcgggaacgcggtagccagggatgcggatgcggtggagcgccagctcgagctggtgaaggcaacagttgtctgttatttctggggtttttcggactttcccttgctctgcatctgctgactctttgctgttatcttgagcttcggtccgaacttcgtcgagagcgtggtgctgagagccgcctcggcggtagcggaaccccaggcaccagcggtactctgtccagcttgggaggcctggatcctgattcccccattacgtcacaccttggacagccaagtccgaagcaacagccattggaaccaggcgaggcggccttgcactccgactcacaagatgggcaccaggactttgattacataatctcattctcatacgggctgcagggcttctgctag

SEQ ID NO: 2485 - DNA, 1176 bp, Artificial Sequence
  Description of Artificial Sequence: Synthetic coding sequence
atggggtatccggaggtcgagcggagggagcttctccctgctgctgcgcccagagagaggggatctcagggctgcggatgtggcggggcccctgcaagggccggcgagggaaactcatgcctattgtttctggggttctttggtctgtccctggctctgcacctgttgactttatgctgctatcttgaactgagatcagaacttaggagggagcggggggccgaatcacgtctgggaggctcaggcactcccggaacttctgggacactgtctagccttggcggcctcgacccggacagcccaattacatcccatttgggccaaccatctccgaaacaacagcctctcgagccaggtgaggccgccctacatagtgactcacaggatgggcaccaaatggcactactcaattttttttttcctgacgaaaaaccatactcggaggaagaaagtagaagggtaagacgtaacaagaggtcaaaatctaatgaaggcgccgatgggccggtgaaaaataagaagaagggaaagaaagccgggccccctggcccaaatggtccccctggtccacccggacctcccggcccccagggtcctcccgggattcctggcatccctggaataccgggaacaaccgtgatggggcccccgggaccccctggacctccagggccccagggaccccccggactccagggtccctcaggggcggcagacaaggccggtaccagggagaatcaaccagccgtcgtgcacttacaggggcaggggagcgctatacaggttaagaacgacctgagcgggggggtcctgaacgactggtcaagaatcactatgaacccaaaggtattcaaactccacccccgatccggagaattggaagtgctcgttgacggcacctacttcatatacagccaggtcgaggtgtattacataaatttcaccgattttgcgtcctatgaagtcgtagtggatgagaagccttttctccagtgtaccaggtcaattgagaccggtaagaccaactacaacacctgctatacggcaggtgtgtgtctgctgaaagcaaggcagaaaatcgccgtaaagatggttcacgcggatattagcatcaatatgagcaaacatacaacatttttcggggctatcaggctgggggaagcacccgcttcttag

SEQ ID NO: 2486 - DNA, 1170 bp, Artificial Sequence
  Description of Artificial Sequence: Synthetic coding sequence
atgggctatccagaggttgaaagaagggagctgctccctgccgccgccccacgtgagagagggtcccaagggtgcggctgcggaggggctcccgcccgggctggcgagggcaattcatgcctgttatttttgggtttcttcgggctgtctttggccttgcacctgctgaccctgtgctgctatctggagctgaggtctgagctgaggcgcgaacggggcgccgagagtcgcctcggaggctcagggaccccgggcaccagcggtaccttatcctctctgggcgggctggacccggatagcccaattacatcccatcttggtcagccttccccgaaacagcagccactagagcccggcgaggctgcactccattccgacagccaggacggtcatcagatggcccttctgaacttcttctttccggacgagaaaccttacagcgaagaagaaagcagaagggtgaggaggaacaagaggagcaaatctaacgagggggccgacggcccagtcaagaataagaagaagggtaaaaaggctggaccccctgggcctaatgggccccccgggccgcccggaccgcccggccctcaaggcccgcctggcatcccaggaattccaggcataccaggcaccaccgtgatgggcccacccggacctccaggtccacccgggcctcagggtcccccaggcctgcaggggcccagcggagctgcagataaggcgggaacccgagaaaaccagcctgccgttgtgcacctccagggccaaggctccgccatccaagttaaaaacgacttgagtggaggagttttgaacgactggtctcggattaccatgaatccaaaggttttcaaacttcacccaaggagtggcgagctggaagtgctcgtggacgggacatatttcatttactctcaggtatattatattaactttacggacttcgcgtcctatgaggttgtggttgacgagaagcccttccttcaatgtacccgcagtatcgaaaccggcaagacaaattacaatacttgctacaccgctggtgtgtgtctactgaaggcaagacagaagattgccgttaaaatggtccacgccgacatttctatcaatatgtcaaaacataccaccttttttggtgcaatccgcctcggtgaagcccccgccagttag

SEQ ID NO: 2487 - DNA, 408 bp, Artificial Sequence
  Description of Artificial Sequence: Synthetic coding sequence
atggggtaccccgaagtggaaaggcgcgagctgctgcccgcggccgctcctcgagagagaggctctcagggatgtggctgcggtggcgctcctgctagggcaggggagggcaattcctgccttttgttcctgggctttttcggcctgtctctggcactgcacctgctcaccctgtgctgttacctggaattgaggagcgagctgcgacgagaacgcggggccgagtctaggctgggtggaagcggcactcccggcacctcaggcaccttgtccagtctgggaggtctcgacccggatagcccgatcaccagtcatttgggccaacctagccccaaacagcagccactggaaccaggtgaggcagccctccactccgactcccaggacggacaccagggacaccaatag

SEQ ID NO: 2488 - DNA, 1161 bp, Artificial Sequence
  Description of Artificial Sequence: Synthetic coding sequence
atgggatatcctgaagtggaacgtagagagctgctcccggccgccgctcccagagagcgggggtcgcagggatgcgggtgcggcggtgcccccgcacgcgccggcgagggaaattcctgcttattattcctcgggttcttcggtttaagtctcgccttgcatctccttaccttgtgctgctatttagagctgaggtctgaactgaggagggaaaggggcgcggaatcacgcttgggaggatctggaactcccggaacctcagggactctatcctccctgggcggacttgatccagacagcccaataaccagccaccttggccagccaagccctaaacagcagcccctggagccaggcgaagcagctttacacagcgatagtcaagacggacatcagatggccttgctgaattttttcttccccgacgagaagccatactccgaggaggaatctcgtagggtccggagaaataagcgctctaagtctaacgaaggggcagacggccccgtcaaaaacaagaaaaaaggaaagaaggccgggccaccagggcccaacggcccccctggcccaccaggtccccctgggccccaggggccacctggaatccccgggattccaggaatccccggcacaacagtgatgggccccccagggccccctggtcccccgggcccccagggtccaccaggcctccaggggccgagcggagcagcggataaagccggtacgcgagagaaccagcctgctgtggtccacttgcagggccagggcagcgctatccaagtgaagaatgggggggtacttaacgactggtctcgcattaccatgaatcccaaggtttttaagttgcacccaaggtccggtgagttggaggtcctcgtggacggaacgtattttatctatagtcaggtgtactatatcaactttaccgactttgccagctatgaagtggtggtcgatgagaaaccgtttctgcaatgcacgcggtccatcgagactggaaaaaccaattataatacatgttacactgctggtgtttgcctgttaaaggcacgacagaaaatagctgtgaagatggtgcacgctgacataagcataaacatgagtaaacacaccaccttttttggagcgattaggctcggcgaagctcccgcttcctag

SEQ ID NO: 2489 - DNA, 447 bp, Artificial Sequence
  Description of Artificial Sequence: Synthetic coding sequence
atggggtatcccgaagttgaaagaagagagctcctcccagctgcagccccacgtgagcgcgggagccagggatgtggatgcggcggagcacccgctagagcaggcgaaggtaactcttgtttattgtttctggggttttttggcctgtcactagccctccatctgctgaccctatgctgctatctggaactgcggtcagaactgcgcagggagcggggagctgagtctcgtttgggagggtccggcacaccggggacctccgggaccttatcctctctggggggacttgaccccgacagcccaatcacgtcgcatctcggtcaacccagtccaaaacagcagccactagaacccggtgaggctgctctacattccgattcccaagacggccatcaggactttgattacatcatttcattctcctacggattgcagggcttttgctag

SEQ ID NO: 2490 - DNA, 3429 bp, Artificial Sequence
  Description of Artificial Sequence: Synthetic coding sequence
atgttagtgctccggtgccggctaggaacatcgttccctaagctggacaatttagtgcccaagggaaagatgaagattctcctcgtgtttctgggcctactgggcaacagcgttgccatgcctatgcacatgccacggatgccgggtttcagttccaaatcagaggaaatgatgcgatataaccagtttaactttatgaacggcccacatatggcccatctgggccccttttttgggaatgggctacctcagcaattcccccagtatcagatgcccatgtggcctcaacccccacctaacacatggcaccctcgtaagagttcggcacccaagcggcataacaagactgaccaaacccaggaaactcaaaagcccaaccagacacagtccaaaaaacccccacagaaaagacccctgaagcagccgagtcacaaccagccccaaccagaggaggaagctcaaccaccccaggccttcccccctttcggcaatggattgttcccataccaacaacccccttggcagataccacaacgtttacctcctcccgggtacggccggccccccatctccaacgaggaggggggaaatccttacttcggctatttcggatatcacgggtttggtggtcgccccccctactacagcgaggagatgttcgagcaggattttgagaagcccaaggaagaggaccctccaaaagctgaatcccctggcaccgagcccacggccaacagcacggtcactgaaaccaacagcacacaacccaatcctaaagggtctcaaggcgggaacgatacttcacccacggggaacagcacgcctggcctcaacactggcaataaccccccagcccagaacgggattggtccacttcctgccgtgaacgcctcggggcagggagggccgggcagccagattccctggcgccctagtcagccgaatatccgagagaaccatccctatcccaatataaggaactttccatccggtcggcagtggtattttacaggtaccgtcatggggcaccgccagaatagaccattctacaggaaccagcaggttcagagaggtccccgttggaacttttttgcctgggaacggaagcaggtagccagacctggaaacccagtttaccacaaagcatacccgcccaccagtcgaggcaactaccctaattacgcaggcaatccagcaaatttgcgcagaaagcctcagggccccaacaagcaccctgttggcacaaccgttgccccccttggtccaaagcccggtcctgtcgtcagaaatgagaaaatacagaacccgaaggaaaaacccctgggcccaaaagagcagatcatcgtgcccaccaagaatcccacttctccttggcggaactcccagcagtacgaggtgaataaatctaattataagttacctcactctgagggctacatgcctgtgccaaacttcaactccgtggatcagcacgaaaactcatattacccaaggggcgactcgcgtaaagttcccaactctgacgggcagacccaatcccagaatttgccaaaaggtatcgttctgggctctcgaaggatgccatacgagtccgagaccaatcagagcgagttgaagcattccagctatcagccagctgtgtatcccgaggaaatcccatcccccgctaaggaacactttccagccgggcgtaacacatgggatcaccaggaaataagcccgcctttcaaagaggaccctggccgtcaggaggagcatctgccacatcccagccacggatcccgcgggtcagtgttttatccagagtacaacccttatgatccaagagaaaactccccttatctgcgcggaaacacttgggatgagagggatgacagtcctaataccatgggtcaaaaggagtcacccctgtaccctattaacacccccgaccagaaggaaatcgtgccatataatgaagaggacccagtggatccgaccggagatgaggtgtttcctgggcagaataggtggggtgaagagctctccttcaagggtggccctactgtgcgacattatgaaggcgagcagtacacctcgaatcagcctaaagagtacctgccctactcattggataatccctctaagcccagagaagatttttactattccgagttttacccttggagtcccgacgagaattttccgagctacaacaccgcatcaaccatgcccccacctatcgagtctagaggctactatgtgaacaatgccgccggtccggaggagagtacactgtttccatcccggaactcctgggaccatcgcattcaggctcagggccagcgggaaagaaggccctacttcaataggaatatatgggatcaggcgactcatcttcagaaggcccccgcccggcctcctgaccagaaggggaaccagccatactattccaacactcccgccggcctgcagaagaatcctatttggcatgaaggcgagaatttaaattacggaatgcaaattaccaggatgaactccccagaaagggagcactcctcctttccaaattttattcccccaagctatccaagtggacagaaagaagcccatttgtttcatctatcacagcggggttcttgctgtgcgggtagcagcactggccctaaggataacccactggcgcttcaggattatacgccctcctacggactggctcctggtgaaaaccaggatacctccccactgtatacagacggaagtcatactaagcagactcgggacatcattagcccaacatccatactccccggacagaggaacagcagtgagaagagagagtcccagaacccctttcgagacgacgtaagcacgctgcgacgaaatacaccctgttctattaaaaatcaattggggcagaaagaaatcatgcccttccctgaggcttctagcctccagagcaagaatacaccatgtctgaagaatgacctgggcggcgatggcaataatatccttgaacaggtgttcgaagacaatcagctgaatgagaggaccgtagacctcacacccgaacagctggtgataggtacgcccgacgaaggatccaaccccgaggggatacaaagccaagtgcaggaaaacgagtccgagaggcagcaacagcgaccatccaatatacttcatttgccttgtttcgggagtaagctagcaaagcaccactcctccaccacgggcactcccagctccgatggtaggcagtcccctttcgacggcgactctataacaccaaccgagaaccccaacaccctggtcgagctagctacagaggagcaattcaagtctataaacgtggaccctttggatgctgacgagcactccccttttgagttcttacagcgaggtacaaacgtccaggaccaggtgcaagactgcctcttattgcaggcctag

SEQ ID NO: 2491 - DNA, 582 bp, Artificial Sequence
  Description of Artificial Sequence: Synthetic coding sequence
atgggcgtgcacgaatgtcccgcctggttgtggctgcttctatctttactcagtctgcctctgggtctgcctgtactgggcgcaccacccagacttatatgcgactcccgggtactcgaacggtaccttcttgaagcaaaagaggctgagaacataactaccggatgcgctgagcactgcagcctcaatgagaacattacagtaccggatacaaaagtgaatttctacgcatggaagaggatggaggtgggacaacaggcagttgaggtctggcaggggctggcgctgctgtcagaggcagtcctaagaggacaggcgctcctggtgaactcgagtcagccatgggaacccttgcagctccatgttgataaggccgtcagcggattaagaagtctcaccaccctcctcagggctctgggagcgcaaaaggaggccataagcccgccagacgctgccagcgcagcgcccctcagaactatcaccgctgatacatttcgtaagctgttccgcgtctacagtaacttcctgcgagggaagctcaagctatacacaggtgaagcttgtagaacaggcgaccgctag

SEQ ID NO: 2492 - DNA, 192 bp, Artificial Sequence
  Description of Artificial Sequence: Synthetic coding sequence
atgccatcttcagtgtcctggggcattctgctgcttgctggactgtgctgccttgtacctgtctccctcgcccatggcgaggggactttcacatctgatctgagtaagcagatggaggaagaagcagtcaggctattcatcgagtggttgaaaaacggggggcccagttccggcgctccgcccccttcctag

SEQ ID NO: 2493 - DNA, 1050 bp, Artificial Sequence
  Description of Artificial Sequence: Synthetic coding sequence
atggaagctgtcaaggctgaagcttgggagggcgcagcagtggctcaagacctactggctttgggttatggtggtgtaccaggagctgcctctcgcggagcctcttgccccgactttcgggggctgtgtgtgagactggcggccgagctggccacactaggagcactggagcaacagcgggaagccggggccgaggtgctttctgccggtgacggcccaggggccgaggaggactttctccgtcagctgggaagcttactccgggagctgcattgtcctgaccgggcattgtgtggcggagacggggctgccgccctccgcgaacctggagccgggctgcggctcctcaggtttctgtgctctgagcttcaagccactcgcctgttgtgtcttcggtccctcctggatccctcaccgcgtccaccgttgggcgaaggggtcgtagagggggccggaatggtgcaggagttggatctgacgctacaggctctgggtctcccacgcccagccccaggaacaccagcctcacagctgcttcaggaacttcacgcaaaaattagcgaactgcaaccgtccctccctcccggatctctgcagcccctgctttcatgctcccttgacgcgccaaggtgggaagcattagaatccctatcgcagagcctgagagatcagtatagatgccggcgatgtcttctgctgaagcgcttggatctgacaacctcagctttccactggagcgatagagctgaggcccaaggggaggccatgcgggccgtcctcatcccaataagggaggtcctcactcccgagagtgatattagtattgctcacgtactggctgcaagggccgatttatcttgtcttgtcccggccacctcagtagctgtgagaagaggcacctgctgcgccataaacaaagtgctcatgggcaacgtgcccgataggggaggcaggcccaacgaacttgaaccaccgatgcctacttggcgctcacgccgagaggatggtggcccacagtgttggggacgcaagaagaaaaagaaaaaatag

SEQ ID NO: 2494 - DNA, 804 bp, Artificial Sequence
  Description of Artificial Sequence: Synthetic coding sequence
atggaggcagtaaaggctgaagcatgggagggggctgcagttgcccaagacctcctcgccttaggctatggtggtgtcccaggggcggcgagccggggggcctcctgtcccgattttcgaggactgtgcgtgagactggcagccgagctggctaccttaggcgccctggagcagcagcgagaggccggagccgaggttttgagcgcaggagacggcccaggggccgaagaggatttcctgaggcagctgggtagtttattgcgggagctccattgtcctgacagggcactgtgcggtggggacggagcagcagctctgagagagccgggagctggcctgcgtttgctgcgtttcctttgttcagagcttcaggctactagacttctctgtctcaggtccctactcgaccctagccctagaccaccactcggtgagggggttgtggagggggccgggatggtacaggagctcgacctcactctccaggcgttgggcttgccccgccctgctccaggtacgcccgcgagccagttacttcaagagctacacgccaaggaggccttggagagtctgtcccagagcttgagagaccaatatcgatgccgtaggtgtcttctgctgaaacgtctggacctgactacatcggcattccactggtcggatagagctgaggtgctcatgggtaacgtaccggatcgaggcgggcggcctaacgagctggaacccccaatgcccacttggcggtcgcggcgtgaagatggtggtccccagtgctgggggcgcaaaaaaaaaaagaagaagtag

SEQ ID NO: 2495 - DNA, 2601 bp, Artificial Sequence
  Description of Artificial Sequence: Synthetic coding sequence
atgttttccatgaggatagtttgtctagtcctttcggtggtgggtactgcctggaccgcagacagcggcgaaggcgacttccttgccgagggcgggggggtccgcgggccaagagtcgtggagcgacaccaaagcgcctgcaaggatagtgactggcccttttgttctgacgaagattggaattataagtgtccctccgggtgcaggatgaaaggcctgattgacgaggtgaatcaggatttcactaataggatcaataagctcaaaaactcgttgtttgaataccagaagaacaataaagacagccactcattaaccaccaacatcatggagatcctacgtggcgactttagtagcgcgaataatcgtgacaacacctacaaccgagtctcagaagatcttagatcaaggattgaggttctcaaaaggaaggtgattgagaaggttcaacacattcagcttttacagaagaacgtaagggcacagctcgtggacatgaagaggctcgaggtcgacatcgatattaagatcagaagctgcagaggctcatgcagccgcgctctggcgcgggaagtggaccttaaggactacgaagaccagcagaaacagctggaacaggtgattgcaaaagatctgctgccatcgcgtgatcgccagcatctgcctcttatcaaaatgaaacccgtacctgacctggtgcctgggaacttcaaaagtcaattacaaaaggtgcccccggagtggaaagccctcacggatatgccccagatgagaatggaactggaacgacctgggggtaatgagataacacggggtggttccacatcctatggtactgggagcgaaacagaaagcccgcggaaccccagctccgcggggtcctggaattctggatcctccggaccaggatccactgggaatcgcaaccccgggtccagcggtactgggggcaccgcgacctggaaaccaggaagttcagggcccggaagcaccggtagttggaattccggaagttctggtactgggtctaccggcaatcaaaacccgggcagcccgcggccaggatccacagggacatggaaccccggcagtagcgaaagaggctcagccggccattggacctctgagtccagtgtgtccggcagtacgggacaatggcacagcgagtctggctcctttcggcctgattctccaggatccggcaacgcccggcctaacaacccagactgggggacttttgaggaagtttcaggcaatgtctctcccggaacaaggagagagtaccataccgaaaaacttgtgacgagcaaaggcgataaggagctccggacaggcaaggagaaggtgacctcggggtcgacaaccactactaggcgctcttgctcaaagactgtgaccaagacagtcataggcccggacgggcacaaagaggtgactaaggaagttgtaacaagcgaggatggatctgactgccctgaagcgatggacctgggaactctctctggcatcgggacattagatggctttcggcatagacacccagacgaggctgcatttttcgacacagcgtcgacgggcaagaccttccctgggttcttttcgcctatgctgggcgagttcgtcagcgagacagagtctcgcggaagtgaaagtggaattttcacaaatacaaaagagtcaagttctcatcaccctggtatcgctgagttcccaagcagaggcaaatcctcatcatattccaagcagtttacgtcctccacaagctacaatcgtggggattccacgtttgagagcaaatcttacaagatggccgatgaagctggatctgaagccgatcacgaaggtacacacagcacaaagcgcggccacgccaaatcacgccctgtgagagattgcgatgatgtgctgcagacacacccgtccgggacgcagtccgggatcttcaatattaagctccccggctcctcaaagatattctcagtttactgcgatcaggagacgagcttaggaggttggctgttgattcaacagcgaatggatggctcacttaactttaaccgtacgtggcaggattataagcgtggattcggcagcctcaacgatgaaggtgaaggcgagttctggttgggtaacgattacctacatcttctgacccaacgggggtctgtcttgagggtggagctggaagattgggccggtaacgaggcctacgcagagtatcactttagagtgggtagcgaagccgaaggctacgccctccaggtcagctcgtatgaaggtacagccggcgatgcattaatcgagggaagcgtggaagagggagccgagtatacctcccacaacaacatgcagttctccactttcgaccgtgatgctgaccagtgggaggaaaactgtgccgaggtttacggcggggggtggtggtataataactgtcaggcagcgaacctgaacggcatctattatcctggaggaagctacgatcctcgaaacaattcaccatacgagatcgagaacggagtagtgtgggtgtccttccgtggcgctgattattctctgcgcgccgtccgaatgaagatcagaccacttgtgacccaatag

SEQ ID NO: 2496 - DNA, 1935 bp, Artificial Sequence
  Description of Artificial Sequence: Synthetic coding sequence
atgttttccatgcggattgtttgcttggtgctatccgtagtgggcacggcatggacagcagattctggcgaaggagactttctggccgagggtgggggagtacgaggcccccgcgtcgtggagagacaccagagcgcttgcaaggacagcgattggcccttttgcagtgacgaggactggaactacaagtgtccgtctggctgtcgcatgaagggccttattgatgaagtgaatcaggatttcacaaatagaatcaacaagttgaagaacagcctctttgaataccagaagaacaataaggacagtcacagtctgacaaccaacatcatggagatcctaaggggcgacttcagtagcgctaacaatcgtgacaatacctataatagggtgtcagaagaccttagatctcggatcgaagttctcaagcgcaaggtcatcgagaaggttcagcacattcagctgctacaaaagaacgtgagagctcaacttgttgacatgaagagacttgaagtagacatcgatattaagattaggagttgtagagggtcatgttctcgggctctcgctagagaagtggatttaaaggactacgaggaccaacagaagcagctcgagcaagttatagcaaaagatctgctccccagcagggaccggcagcatcttcccttgattaagatgaagcccgtccccgacctggtgccaggtaatttcaaatcccagttgcagaaggtgcctcccgaatggaaagccctgactgatatgccccagatgagaatggagttggagagacccgggggcaatgaaattactcggggcgggtccacctcatatggaaccggatctgagaccgagtcacccaggaatccatcttcagcaggttcatggaactctggctcatcaggccccggaagtacagggaacaggaaccctggatcaagcggcacgggcggcactgccacttggaagcctggttcttctgggcctggctcaaccggctcctggaattctggttcttcagggaccggatcgacgggaaaccaaaatccagggagccctagacccggatccactggcacctggaacccaggaagctccgagaggggtagcgcggggcattggacatcagagagttccgtgtcgggatccaccgggcagtggcatagcgagtcaggctccttccggcccgactcacctggatctggaaatgcccggccaaataacccagactgggggacatttgaggaggtctctggaaatgttagccctggtacacggagagagtaccatacagaaaaactcgtgacatcaaagggagacaaggagctgcgaaccgggaaagagaaagtcacttcaggtagtactacgacaacccgccgatcatgttccaaaacagtgacaaaaactgttattggtccagatgggcacaaggaagtaacaaaggaagtcgtgactagcgaggatggttccgactgccctgaagctatggacctgggtaccttgtctggcatcggtacgcttgacggcttcagacaccgccacccagatgaagccgccttcttcgataccgcgtccaccggtaagacgtttcctggctttttctccccgatgttgggagaattcgtgtcagaaacagagtcccgcgggagcgaaagcgggattttcactaacacgaaagaaagcagttctcatcatccgggcattgccgaattcccaagcaggggcaagagcagctcctattcaaaacagtttacaagtagcacttcatataaccgcggggattcaacctttgagtccaagagttataaaatggctgacgaagctggatccgaagctgatcacgagggcactcatagcaccaagcgcggacacgccaagagcaggcccgttagaggtatccatacctccccactaggtaaacccagcttgtcaccttag

SEQ ID NO: 2497 - DNA, 870 bp, Artificial Sequence
  Description of Artificial Sequence: Synthetic coding sequence
atgttttccatgaggatcgtatgtctggtcctcagcgtggtgggtacggcctggacagctgacagtggagagggggatttccttgccgagggaggaggagttcgtgggcccagggtggttgaacgccaccagagcgcctgcaaagatagtgactggccattttgctctgatgaggattggaactataaatgtcccagtgggtgccgaatgaaaggcctcattgatgaggtgaaccaggactttacgaacagaattaataaactcaagaactcattgttcgaatatcagaagaataataaggatagtcacagcttgacgacaaatataatggagatcctgagaggtgatttcagctcagcaaacaatagagataatacatacaatagagtgagtgaagatctgcgctcccgaattgaagtgctaaagcgaaaggtgatcgagaaggttcaacacatccaattactgcagaaaaacgtgagagctcagctggtggatatgaagagactggaggtggacattgacatcaagatccgttcttgtaggggctcttgctcaagagcattggcccgggaagttgacctgaaagattacgaagatcagcaaaaacaactcgagcaggtgatcgcgaaggatcttctacctgtcgtaaatttgcaggttacagccaataatctccttgtggcccgcgtgactacagaggagactcctcacctgaaagctagagcaataaagtggcagatgcggcctgaagtgaaacccattatgaaggagcacatcgcacccagagaggctatgctgaacctcgcactctctgaagtgtctactctactcctgtggggcagtctaccatgcccaccccgcctcagctag

SEQ ID NO: 2498 - DNA, 1476 bp, Artificial Sequence
  Description of Artificial Sequence: Synthetic coding sequence
atgaaacggatggttagttggtcttttcacaagcttaagaccatgaaacacttactgttacttctgctctgcgtttttctagtcaagtctcaaggcgtgaatgacaatgaagagggtttttttagcgctaggggccaccggccattggacaagaaacgggaagaggcccccagccttcggccagcaccccctcctatatccggcggcggatatagagctcgccctgcaaaagcggcggcaacacagaaaaaggtggaacgaaaggcaccagatgctggaggctgccttcatgctgaccccgacctgggagtactatgtccgaccggctgccaactgcaggaagccctactgcagcaggaacgacctattcggaattctgttgatgagctgaataataacgtagaagccgtgtctcagacgagctctagttctttccagtatatgtatcttctgaaggatctgtggcagaagcggcagaaacaggtcaaggataacgaaaatgtcgtgaatgaatactcttccgaactggagaagcatcagctgtacatcgatgagactgtcaacagtaatatccctacgaatctccgggttctgcgatctatattggaaaacctccggtcaaaaatacagaagcttgagagtgacgtttcagcccagatggaatattgtcgcacgccctgcacagtgagctgtaacataccagtagtctccggcaaggaatgtgaagaaattatccgcaaggggggcgaaacatctgagatgtatctgatccagcctgatagttccgtgaagccatacagagtatactgtgatatgaacactgagaacgggggttggacagtgattcaaaatagacaagatgggtcggtcgattttggccgcaagtgggatccatacaaacagggttttggcaacgtggccaccaacaccgacgggaaaaactattgtggactgcccggagaatactggttgggtaacgacaaaattagtcagctcacgaggatgggtcccaccgagctcctgatcgagatggaggattggaaaggggataaggtgaaggcccattatgggggcttcaccgtgcaaaacgaggctaacaagtatcagatttcggtgaacaaatatcggggaaccgcgggaaatgcacttatggatggagcatctcagctgatgggcgaaaatcgcacaatgacaatccacaatggcatgtttttttccacgtatgacagagacaatgacgggtggctgacctccgacccccggaagcagtgctcgaaggaggacggaggcgggtggtggtacaatagatgtcatgcagcaaatcctaacggtaggtattactgggggggccagtacacttgggacatggctaaacacggcacagatgatggcgtggtatggatgaattggaagggatcctggtacagcatgcggaaaatgtcgatgaaaatccggccatttttcccacagcagtag

SEQ ID NO: 2499 - DNA, 1425 bp, Artificial Sequence
  Description of Artificial Sequence: Synthetic coding sequence
atgaagcgcatggtcagctggagcttccataaactcaaaacaatgaaacacctgctgcttctcctgctgtgcgtgtttctcgtcaaatcccagggagtaaacgataatgaggaagggttcttctccgcccgtggacaccgtccacttgataaaaaacgggaagaggcacgccccgcaaaggccgctgcaacccagaagaaagtcgagcggaaggcacctgatgcgggcggatgtctgcatgcggatccggacctgggagtgctctgcccaacgggatgtcaactgcaagaggctttactgcaacaggaacgcccgattcgtaactcagtggatgaattgaacaacaatgtggaagcggtcagccagacgtcttcctctagtttccaatacatgtacttactcaaggatctttggcagaagaggcagaagcaggtcaaagataacgaaaacgtggtcaacgaatactcaagcgaactggagaaacaccagctctatatcgacgagacagtgaattcgaacatacctacaaacctacgggtactgcggagtattcttgaaaacctccgttccaaaatccagaaattggaaagcgacgtctcggcacagatggaatactgccgaaccccctgcacagtgtcatgtaatatcccggtggtgtcggggaaggaatgtgaggagatcattagaaaggggggggaaacgtccgagatgtatctcatacaacccgactcctccgtgaaaccttaccgggtgtactgtgatatgaacacagagaatggcggctggactgtgatccagaacagacaagatggctcagtggacttcggaaggaagtgggacccttacaagcaaggcttcggaaacgttgccactaatacagatggcaagaactactgcggcctgcctggtgaatactggctcgggaacgacaaaatttcccagttaacacggatggggcctaccgaacttttaatcgaaatggaagactggaaaggagacaaagtgaaggcacattacggaggcttcaccgtgcaaaacgaggctaataagtaccagatctccgtgaacaagtacagaggcaccgccggcaacgctttgatggatggcgcttcccagctcatgggagaaaatagaacaatgacaatacacaatgggatgtttttttctacctatgaccgggacaatgatggttggctaacctccgacccaaggaaacaatgctcgaaagaggacggtggtgggtggtggtataatcgctgtcacgctgcgaacccaaatggtaggtattattggggtggccaatacacatgggacatggcaaagcatggcactgatgacggggttgtttggatgaactggaagggaagctggtacagcatgcgtaagatgtccatgaaaattcgacctttcttccctcagcagtag

SEQ ID NO: 2500 - DNA, 1362 bp, Artificial Sequence
  Description of Artificial Sequence: Synthetic coding sequence
atgtcctggtccctgcacccccggaacctcatcctttacttctatgcactcttgttccttagttctacgtgtgttgcttatgttgctacacgggacaactgttgcatactggatgagagatttgggagttattgtccgacaacttgtggcatagcggattttctatctacctatcagaccaaggtggataaagaccttcagtcgttggaagacatcctgcaccaggtggaaaacaagacctccgaggtgaagcagttaatcaaagcaattcagctaacctacaatcccgacgagtcatcaaagccgaacatgatcgacgcagcaacattgaagtcacgcaagatgctggaagagatcatgaagtacgaagcaagcatcctgactcacgacagttccataagatatctacaggaaatctataatagtaacaaccagaaaatcgtcaatttgaaagagaaagtggctcagctggaagctcagtgccaggaaccttgcaaagacaccgtgcaaatccacgatatcaccgggaaggattgtcaggacattgctaacaaaggggcaaagcagtctggcctttactttattaagccattgaaagcaaatcaacaattcctagtgtactgtgagatcgatggatcaggaaatggttggaccgtcttccaaaaacgcctggatgggagcgtggacttcaagaaaaactggattcagtataaggaggggttcggacacttgtctccgacaggcaccacagagttttggctgggaaacgaaaagattcacctgatcagcactcagagcgccattccttatgccctacgcgtggaactggaagattggaacggccggacatcaactgctgactatgccatgttcaaggtgggaccagaggccgataagtataggttgacttacgcatacttcgcgggtggcgacgccggagacgcgttcgacggctttgatttcggggatgatccctccgataaattctttacttctcataacggcatgcagttcagcacttgggacaatgacaacgacaagtttgagggcaactgcgctgaacaagatggatcagggtggtggatgaataaatgtcacgctgggcacctgaacggcgtgtattaccagggaggtacatattcaaaagcttccactcctaatggctacgacaacggcatcatatgggcaacttggaaaaccagatggtacagcatgaagaagactacaatgaaaataataccgtttaatcggctgactatcggagagggacagcaacaccatctaggcggcgcgaaacaggtgcgccccgaacacccagcagaaaccgaatatgactccctgtacccagaagacgacctgtag

SEQ ID NO: 2501 - DNA, 1314 bp, Artificial Sequence
  Description of Artificial Sequence: Synthetic coding sequence
atgagctggagtttacacccacgtaatctcatcctgtatttttacgctctcctgtttctttcatctacgtgtgtggcatacgtagcaacgcgagataattgttgcattttggacgagcgtttcgggtcttattgtcctaccacttgcggcatcgcagatttcctgtccacctaccagactaaggtggacaaagacttgcagtctctggaggatatattgcaccaggtggaaaataagacttccgaagttaaacagctgatcaaggctattcagttgacatataaccctgacgagtccagcaagcctaatatgatcgacgccgcaacactgaaatctagaaagatgttggaggagattatgaaatacgaggccagcattctgacacacgattcctctatccggtacctgcaggagatctacaactctaataatcaaaaaatagttaatttgaaggagaaggtcgcgcagctcgaggcccaatgtcaagaaccgtgcaaggacacagtccagatccacgatatcacggggaaagattgccaagacattgcgaacaaaggcgctaaacaaagcggtctttacttcatcaagcccctgaaggctaatcaacaattcctggtgtactgtgagatagacggcagcggtaatggctggaccgtgtttcagaaacgactggacggcagcgtggatttcaagaaaaactggatccagtataaggaggggttcggccacttgtctcctaccggaactactgagttttggttgggtaacgagaagattcaccttatcagtacacagtcggcaataccttatgctctccgagtagaactggaggactggaatggcaggaccagtacagctgactatgccatgttcaaggttggtccagaggctgacaaatacaggctgacatatgcatacttcgcagggggggatgctggggatgcctttgacggattcgacttcggtgatgaccctagcgacaagttcttcacaagccataatggaatgcaattcagtacatgggacaatgacaacgataagttcgagggcaactgtgcagagcaggatggtagtggctggtggatgaataaatgtcacgctggccacctaaatggagtgtactatcaagggggtacatattctaaggcttccacgcccaacggatacgacaatggaataatatgggcaacttggaagacaaggtggtacagtatgaagaagacaacaatgaaaattattccgttcaaccgtctgactataggggaaggacaacagcatcatctggggggggctaaacaagctggcgacgtttag

SEQ ID NO: 2502 - DNA, 2892 bp, Artificial Sequence
  Description of Artificial Sequence: Synthetic coding sequence
atgctttcaggggaacggaaggaaggcggatcgcctagattcggcaagctgcaccttccagtaggcctgtggatcaatagtcctaggaagcagcttgctaaattaggcagaaggtggccttcagccgcttccgttaaaagcagttctagtgataccgggagccgctcctcggagccgctgccacctcctcccccacacgtcgaactgcgtcgtgtgggcgctgtgaaggccgctgggggggcgtccggttccagagccaagcgtatctcacagctctttcggggatcgggcaccgggaccacaggctcgtcgggcgctggagggcccgggactcctggcggcgcgcagaggtgggcatctgagaagaagctgcccgaactggctgccggcgttgctcctgagccccccctggcgacacgcgcaaccgcgcctccaggagtgctgaagattttcggtgctggccttgcatccggggctaactataagtccgtgctggctaccgcccggagtaccgctagggaattggtagccgaggctcttgaaagatatggcctcgccgggagtccaggcggcgggcccggcgagagctcctgcgtggatgccttcgctctgtgtgacgctctgggccgcccagcagccgcgggcgtggggtctggcgagtggcgcgccgaacacctcagggtgctgggagacagtgagcgacctctgttggtgcaggagctctggagagcccgaccaggttgggcaaggcggttcgagctccgcggccgcgaagaggcccgcagactggagcaggaggcttttggcgccgcagattccgaaggcacaggcgccccctcatggagaccccagaagaacagatcccgcgctgccagcggaggcgcggccctggcatctccaggtcctggtacaggctcaggggcccccgcaggctcaggcggaaaagaaagatcagaaaatctatcactgcgcaggtcagtgagtgagctgagcctgcagggacgcagacgtaggcagcaggaaaggaggcagcaagcactgtccatggctccaggggcggcagatgctcaaataggaactgcggacccaggagatttcgaccagctcacccagtgtttaattcaggcaccatctaatcgtccatactttcttcttctgcaaggctatcaggacgcacaggactttgtggtatatgtaatgaccagggaacagcatgtttttggtagaggcgggaacagctccgggcgcggcggctcacctgcaccgtacgtggacacattccttaatgcccccgatattctgccacgccactgtacagtgcgtgccggtccggaacaccctgccatggtgagacctagcaggggagctccggtaacccacaacggttgcttactactgagggaggccgaactacaccccggggatttactcggactcggagagcacttcttgttcatgtacaaagacccccgcaccgggggatccggccccgctcgccctccctggcttcctgcccgccctggagcgacacctccaggcccggggtgggccttttcctgtcgcttgtgtggacgcggtctgcaagaacggggggaggccctggcggcttatctcgatggacgagagcccgtgctcagattccggcccagggaggaggaagctctcctgggtgagatcgtgcgcgccgctgcagccggaagtggtgatctcccgccactcggccctgcaacccttctcgccctgtgcgttcagcattctgcaagagaactcgagcttggtcacctcccccgtctcctggggagactagcgagattaattaaagaagccgtctgggaaaaaataaaagagatcggagaccgccagcccgaaaatcaccctgaaggtgtgccagaggtgcctctaacgccagaagcagtgtctgtcgaactgcgcccattaatgttgtggatggctaacacaacagagctgctctcattcgtgcaggagaaagtgttggagatggagaaggaagccgaccaggaggatccccagctgtgcaacgacctggagctatgtgacgaagcgatggccctgcttgacgaggttattatgtgcactttccaacagagcgtgtactatctgactaaaacgctgtattctaccttgcccgctctgctcgactcaaatccatttaccgccggagctgagttacctggcccaggagccgagctaggagcaatgcctcctgggcttcggccaacgctcggagtctttcaggcagcactcgagttaacctcccagtgcgaactgcatcccgatctggtgagtcagacattcggatacctctttttcttttcaaatgcctcgcttttaaacagtctgatggaacggggccaaggacggcccttctaccagtggtctcgcgccgtgcaaattaggactaatctggaccttgtgctggactggcttcaaggtgcaggactgggcgacatcgccaccgagtttttccggaaactctctatggccgtgaacctcctttgcgtcccccgcacctctttgctgaaagcttcttggtcaagccttcggaccgaccaccccaccctcacccctgctcagctgcatcatctgctgagccactaccagcttggacctggacgcggaccgcctgcagcctgggatcctccacccgctgaaagagaagccgttgacacaggtgacattttcgagagtttttcatcgcacccccctcttattctcccattgggcagcagcagactcagactgacagggccggttaccgatgacgcattgcatcgtgagttgaggagacttcgaagacttctgtgggacttggaacagcaggagttgccggccaactacagacacgggcctcctgttgccactagcccatag

SEQ ID NO: 2503 - DNA, 630 bp, Artificial Sequence
  Description of Artificial Sequence: Synthetic coding sequence
atggattcggacgagacaggattcgagcactctggcctgtgggttagcgtattggccggcctgttgctcggggcatgtcaagctcaccccattcctgattcaagccctctactccaattcggcggtcaggtgaggcagcgatacctgtataccgatgatgctcaacagactgaggcccacttggagataagggaagacggaaccgttggtggcgccgctgaccagtcacccgagtctttgctgcagctgaaagctctcaaacctggagtgatccaaatcctgggggtgaagacatcccgatttctctgtcagcggcctgacggggccctgtacggaagcctgcactttgaccctgaggcgtgctccttccgggagttgctgctggaagacggctacaacgtgtaccagtctgaggcgcacggacttcccctgcacctccccggcaataaaagtccacatagggaccctgcgccacgggggcctgcaaggttccttcctctcccaggtttacctccagcgctgcccgagcctccaggcatcctggcacctcaaccgcctgatgtcgggtcatcagacccactgtctatggttggaccctcacagggacgctctccgtcctacgcgtcgtag

SEQ ID NO: 2504 - DNA, 321 bp, Artificial Sequence
  Description of Artificial Sequence: Synthetic coding sequence
atgcttcgcttcattcaggaggttaatactaccactaggtcatgtgctctctgggacctggaagaggatactgagtatatagtccatgtacaggctatctccattcagggtcaatcccctgctagcgagcccgtcctgttcaagacgccgagggaggcagagaaaatggccagtaaaaacaaagacgaggtcactatgaaggagatgggaaggaaccaacagctgagaaccggagaggttttgatcatcgtagtggtgctctttatgtgggcaggagtgatcgcactgttctgtaggcagtacgatattatcgaagcttag

SEQ ID NO: 2505 - DNA, 414 bp, Artificial Sequence
  Description of Artificial Sequence: Synthetic coding sequence
atgttacgcttcattcaggaggtgaacacaacaaccaggagttgcgctttgtgggaccttgaagaagacaccgagtacattgtacatgtccaggcaatcagcatacagggccaatcacctgcgtcagagccagtgctgttcaagaccccaagggaggcagagaagatggcatcaaagaataaggacgaggtgacgatgaaagagatgggcagaaaccaacagctgcggaccggagaggtgctgatcattgtggtggtgctcttcatgtgggctggcgtaatcgcactgttctgtagacagtatgatattatcaaagacaacgagcctaataataacaaagagaagactaaatccgccagtgaaacttccacccccgaacatcaggggggggggctgttgcgcagtaaaatatag

SEQ ID NO: 2506 - DNA, 390 bp, Artificial Sequence
  Description of Artificial Sequence: Synthetic coding sequence
atgaagacactccaatttttctttcttttttgttgctggaaggccatttgctgtaatagttgcgagctgacaaatattaccattgcaattgaaaaagaggaatgtcggttttgtatatctattaacactacatggtgtgcagggtactgctacacacgcgatctcgtttacaaagacccggcccggcctaagattcagaagacctgtactttcaaggaactcgtttacgagacggttagagtacccggctgtgcccatcatgccgacagcctctacacctatccggttgctacccaatgtcactgtggaaagtgcgatagtgacagcaccgattgcactgtgagagggctgggtccatcctactgctcttttggagagatgaaagagtag

SEQ ID NO: 2507 - DNA, 390 bp, Artificial Sequence
  Description of Artificial Sequence: Synthetic coding sequence
atgaagacactccagttcttcttcctgttttgctgttggaaggcaatttgctgcaattcatgcgaacttacaaacatcaccatcgccatagagaaggaggaatgtagattctgtatttcaattaatacaacctggtgtgccggttactgctacaccagggacctggtatataaggatccagctcgacctaaaattcagaaaacatgcacttttaaagaactagtatatgagactgtccgggtcccaggatgtgctcaccatgcagactcactgtatacctacccggttgcaacacaatgtcactgcgggaagtgtgatagtgatagcactgactgcacagtaagagggctcggtccgagctattgcagtttcggggagatgaaggaatag

SEQ ID NO: 2508 - DNA, 390 bp, Artificial Sequence
  Description of Artificial Sequence: Synthetic coding sequence
atgaaaactttacagtttttcttccttttctgctgctggaaagctatttgttgcaattcatgcgagctgactaatattacaattgccatcgagaaggaagaatgcaggttttgcatttcgattaataccacgtggtgtgccggctactgctatacaagggatcttgtgtataaggaccccgcacggcctaagatccaaaagacttgtaccttcaaggaactcgtctacgaaaccgtgcgggtcccaggatgcgcccaccatgctgactcattgtatacttatcccgtggcgacccagtgccattgtggcaaatgtgactccgattcaactgactgtactgtgcgcggccttggcccctcctactgctcatttggagagatgaaagagtag

SEQ ID NO: 2509 - DNA, 1260 bp, Artificial Sequence
  Description of Artificial Sequence: Synthetic coding sequence
atgtccttcatacccgtggccgaagatagtgacttccccatccacaacctcccatatggtgtgttctcaacccgtggcgatcctcgcccaagaataggggtagcgatcggggatcagatccttgacctcagtattattaagcacttgtttaccgggcccgtcttgagcaaacaccaggacgtgtttaaccagccaacactgaatagttttatggggctaggacaggcggcctggaaagaggcccgtgtttttctgcagaatttgttgtctgtatcacaggctcgcctgcgcgacgacacggaactgcgcaagtgcgcatttatttcacaggcaagtgccaccatgcacctccctgctacaattggtgactacaccgatttttactcgtcgagacagcacgcaaccaacgtcggaatcatgtttagggataaggaaaatgccctcatgccaaactggttacatctccccgtaggttatcatggcagggcctcttctgtggtcgttagtggaacaccaattaggcgacctatgggccagatgaaacccgacgactctaagccccctgtgtatggcgcatgtaaactactggacatggaactcgagatggccttcttcgtgggacctgggaatcggttgggcgaaccaatccctattagtaaagcccatgaacatatatttggcatggtcctcatgaacgactggagtgctcgcgatatccaaaagtgggaatacgtgccactcggcccattccttgggaaaagtttcggtactacggtctccccatgggtggtgcctatggatgcactaatgccttttgccgtgcctaaccccaaacaggatccacgcccactgccttatttgtgccacgatgagccatatacctttgatatcaacttgtcggtcaacctgaagggagagggtatgtcacaagccgccacaatatgcaagagtaacttcaaatacatgtactggacaatgttacagcaactaacccatcattccgtcaatggctgcaatttgagacctggcgatctactcgcttcgggcaccatttccgggcctgagcccgagaacttcgggtctatgctggagctgagctggaaggggactaagcccatcgatcttggtaatgggcagacccggaagttcctactggacggtgatgaggtgattatcacagggtactgccaaggcgatggctaccggattgggttcggccagtgtgcaggcaaggttcttcctgctctcctgccttcttag

SEQ ID NO: 2510 - DNA, 1260 bp, Artificial Sequence
  Description of Artificial Sequence: Synthetic coding sequence
atgtcattcattccggtcgccgaagacagcgattttcccatccacaatctgccatacggagtctttagtacccgtggcgaccctagaccaaggataggcgtggctatcggcgaccagattctggatctttcaatcattaagcacctctttacagggcccgttctatctaaacaccaggatgtgttcaatcagcccacactgaattcctttatgggcttgggtcaggctgcctggaaggaggcgagagtgttcttacagaatctgttatccgtgagccaggctcggctgcgcgacgatacagagctaaggaagtgtgcatttatatctcaggcgagcgccaccatgcatctccctgccaccattggagattatacagacttctatagcagcagacagcatgccaccaacgtcggcataatgttccgggataaggagaatgcactcatgcctaattggcttcacctccctgttggctaccacggccgcgcctcttcggtcgtcgtgtctggcacccctattcgtaggcccatggggcagatgaagcccgatgattcaaaaccccccgtgtatggcgcctgtaagcttttggacatggagctggaaatggccttttttgtaggaccgggaaatagacttggcgaaccaattcctatctcgaaagcccacgaacacatctttggcatggtcttgatgaatgactggagcgctcgcgacattcagaagtgggagtatgtcccgcttgggccctttttagggaagtccttcggtaccaccgtgtccccttgggttgtgcctatggacgctctgatgcccttcgcggtgccgaatcccaagcaggatcccagaccactgccgtatctctgccatgatgagccgtatacctttgatataaatctgtctgtcaatctgaagggcgaaggcatgtctcaggctgctactatctgtaagtccaacttcaagtacatgtactggaccatgctccaacagctgacccaccattcagtgaacgggtgcaatctcagaccgggggatctgctggcctccggaaccatcagcggtcctgagccggaaaactttggaagcatgctggaactatcttggaaaggcactaaacccatagacctgggcaacggccaaactcggaagtttctgttagatggcgatgaagtgatcatcaccggatattgccagggtgatgggtatcgcattggatttggtcagtgtgcaggcaaggtgcttccggcactgctgccttcttag

SEQ ID NO: 2511 - DNA, 1260 bp, Artificial Sequence
  Description of Artificial Sequence: Synthetic coding sequence
atgtccttcatacccgtggctgaggacagcgactttcccatccacaatctgccctacggggtttttagcactaggggcgatccacgcccaagaattggtgtagctattggggaccagatcctcgacttatccatcatcaagcacctctttactgggccagtgctgtccaaacatcaagatgttttcaatcagcctactttaaatagcttcatgggccttggacaggccgcctggaaagaagctcgagtttttctgcagaaccttctaagcgtgagccaggcaaggctccgcgacgacaccgagttacgaaagtgtgcctttatttcacaggcctctgcaaccatgcatctcccagccacaatcggcgactacactgacttttactcatctcgccagcacgcgacaaacgtcgggatcatgtttcgcgataaagagaatgccctcatgcccaactggctgcacctccccgtgggctatcacggcagagcctcttctgttgtggtttccggtacgccaattaggcggcctatgggccaaatgaaacctgacgattctaagcctcctgtctacggcgcatgtaagcttctggacatggagctggaaatggccttcttcgttggacctggtaatcgcctcggggagcccattcctatttccaaggcgcacgaacacatattcggaatggtgttaatgaatgactggtctgcccgggacatccagaaatgggaatatgtccccctgggcccttttttaggaaaatcattcggcactactgtatctccttgggtcgtgcccatggacgccctgatgcctttcgccgtgcccaatcccaaacaagatccgagaccccttccctatctatgtcatgacgagccttacacgttcgacattaatttgagcgtgaacttgaaaggcgagggcatgtctcaggccgctactatatgcaagtctaactttaagtatatgtactggacaatgctccagcagctgacacatcactccgttaacgggtgtaatttacgaccaggggatctgctagcaagtggaacgatttctggccccgagccagagaatttcggcagcatgctcgaactgtcctggaagggtactaaacctatcgacttaggcaacggccagacaaggaaatttctgttagacggcgatgaggtcatcatcactggatattgccagggggatggctacagaatagggttcggccaatgcgccgggaaggtcctccccgcccttctcccaagctag

SEQ ID NO: 2512 - DNA, 759 bp, Artificial Sequence
  Description of Artificial Sequence: Synthetic coding sequence
atggaagctatgtggcttctctgtgtcgctttggccgtcctggcctggggcttcttgtgggtgtgggattcttcagagcggatgaagtccagggaacaggggggccgcctgggggctgagtcccgcactctcctggtaattgcccacccagacgacgaggcaatgttttttgctccaacggtgctcggactcgctcgtctgcgccactgggtgtacctcctgtgcttctccgctggtaattactacaatcaaggggagactcggaagaaggaactcttacagtcctgcgatgttctgggtatccccttaagtagcgtaatgattattgacaatagagattttccagatgatcccggtatgcagtgggacactgagcatgtggccagagttctgctacagcatattgaagttaacgggatcaacttggtcgtcacatttgatgctgggggcgtatctggacacagcaatcacatagccttgtacgctgcggtcagagcgctgcactctgagggcaaactgcccaagggctgctctgtgctcaccctgcagtcagtgaatgtgttaagaaaatacattagtctgctggatctgccgctcagcttgctgcacacgcaggatgttctctttgtgctcaatagtaaggaagtcgcacaggcgaagaaagccatgtcttgccacaggtcccagcttttatggtttcgaaggttgtacataatcttttccaggtatatgcgaattaattcgttgtccttcctgtag

SEQ ID NO: 2513 - DNA, 1203 bp, Artificial Sequence
  Description of Artificial Sequence: Synthetic coding sequence
atggcggcattacgacagccacaggtggcagagctccttgccgaagcgcggcgggcctttagagaggagttcggagctgaacctgaactcgccgtgtccgcccccgggcgggttaatttgattggggaacacaccgactacaatcagggccttgtgctacccatgagggacagactattccccacgctcgagggaagaaagaggggatccggccgggaacgagtgcgggggaggctgctggcccaggctcgccctctgggcgccggcgcgccaaggctgcaaccagggtccatgtttcccctgaactgcgaggccttatgtgccacgcaaaagggcacattacgagctagcggccatcggggtgccccaactgcagatctcggagagcgatccctcctggctcaaccagtccagttcacagaagaagagaccggaggtgcatttagacccatctgttcccttgggtctgctcaggctagctctcctccatgccccaccgctcagggtcgagtccaggacggcctagtgtccctactcactacgtctgagggagctgacgaacctcagagactgcagttcccgctacccacagcccagcgatcactcgaacctgggacaccgcggtgggcgaactatgtgaaaggcgttatccagtattacccggcagcccccctcccaggatttagtgccgtcgtagtgagtagtgtgcccctgggcggggggttaagtagctccgccagtctggaggtggccacgtatacattccttcaacaactgtgcccggacagtggaacaatagcggccagggcccaagtctgccagcaggccgagcacagctttgccggcatgccgtgtggaatcatggaccagttcatatcccttatgggccaaaaaggccacgccctgctgattgattgcaggagcctggagaccagcctcgtgcctttaagcgatcccaaactggccgttcttatcacaaacagcaatgtgagacacagtttagcctcatctgagtatccagtcagaaggaggcaatgcgaagaagtcgcaagagcattgggaaaggaaagtttgcgcgaagtgcaattggaagaactggaagccgcgcgtgatctcgtgagtaaagagggatttaggagggctcgccacgtggttggggagataaggagaacagcagacggtgccaaagtgctgtgcctatag

SEQ ID NO: 2514 - DNA, 1269 bp, Artificial Sequence
  Description of Artificial Sequence: Synthetic coding sequence
atgtgcgcccccccaaggggcgctccgccagagcatccggctccgacaggcctgtgccgatcttcttgtgctgaactgcaggctcgggttatggctgccttacgacagccacaggtcgctgaattgctggctgaggctcggcgagcctttagagaggaattcggtgctgagcccgagcttgcggtgtctgccccagggagagtcaaccttatcggcgagcatactgactacaatcagggactcgtccttcccatggccctggaattgatgactgtgttagtcggctctcctagaaaggacggattggtttcattgctgactacctcagagggcgccgatgaacctcaaaggttgcaatttccactgcccactgcccagagatcactcgaacctggaacccccaggtgggccaactacgtgaagggagtcatccagtactacccggccgcacctcttccaggattttccgccgtagttgtgtcctccgttccgcttggtggaggtctctccagctcggcctctcttgaggtggccacgtacacattcctacagcagctctgccctgatagcggaacgatcgctgctagagctcaagtttgccagcaggctgaacactccttcgctggtatgccgtgcggaattatggatcagttcatcagcctgatgggccagaagggccacgctctgctgatcgactgccgtagcctggaaaccagcctcgtgccactatctgatccaaagctcgccgtcctaattacaaacagcaacgtcaggcattccctggcttctagcgagtaccccgtgaggcgaaggcagtgcgaggaagtggctagggccctcgggaaggaatctctgcgcgaggtccagctggaggagctggaagctgctcgtgatttggtgtctaaggagggctttcgcagggctagacatgtcgtgggggagatcaggaggacggcacaggctgcggcagctctgcggcgcggtgactacagagctttcggcagactgatggtcgagagccacagatccctcagagatgattatgaagtgtcttgcccagagttggatcagcttgtggaggcagccttggccgtgccgggggtttacggctctcgcatgacgggcggaggattcggcggctgcaccgtcacgctccttgaggccagcgcagctcctcacgcaatgagacacatccaggaacattatggcggcacagccacattctacctttctcaggcagccgacggcgctaaggttttgtgcctgtag

SEQ ID NO: 2515 - DNA, 1179 bp, Artificial Sequence
  Description of Artificial Sequence: Synthetic coding sequence
atggccgctcttcgacagccgcaggtggccgagcttctcgccgaagcgcgccgcgcatttcgcgaggaatttggcgctgaacccgagctggccgttagcgccccaggccgggtaaacctcattggtgagcataccgattacaatcagggcttagtgctgccgatggctctcgaactcatgactgttctggtaggctcacctagaaaggacggattggtgagtctactcacgacaagtgaaggggcggatgagcctcaacggctgcagtttccactccccacagcgcagcgttctctagagcctggcaccccccggtgggcaaattacgtcaagggagtgattcaatattaccccgctgctccgttgcctggatttagcgctgtggtcgtgtcatcggtgccccttggagggggactttcgtctagcgcatccctggaggtcgccacatatacattcctgcagcagttatgtcccgatagtggcactatagcagcacgcgcacaggtgtgccagcaggctgagcacagctttgctggtatgccttgcggaattatggaccaattcataagtctgatgggacagaaggggcatgcactgctaatcgactgtcgctctctggaaacgtccctggtccctctatccgatcctaaactggctgtgttgataacaaactcaaatgtcagacattcactggcatccagtgagtacccagtccgcagacgccagtgcgaggaagtggcacgtgcattgggcaaggaaagcttgcgtgaagtccagttagaggagctcgaggccgcccgcgacctggtgtcgaaggaggggttcagaagagcaaggcacgtggtgggagagatccggaggacagcccaggctgcagccgccctcaggcgcggcgactaccgggcatttgggagacttatggtcgaatctcaccgatcactccgggacgattacgaggtgtcttgtcctgagcttgatcagctggttgaggccgcgttggctgtaccaggtgtttacgggtcccgcatgacgggaggcggtttcggcggctgcaccgtgactctcctcgaagcctccgcggcgccccacgcaatgaggcacatccaagaacattacggcggaactgccaccttctacctgtcccaggcagctgatggcgcaaaggtcctgtgcctctag

SEQ ID NO: 2516 - DNA, 1569 bp, Artificial Sequence
  Description of Artificial Sequence: Synthetic coding sequence
atggccgctgtggtggcggctacgaggtggtggcagctgctcctcgtcctgagcgccgccggcatgggtgccagtggcgccccacagcctcctaatattttgttactgttgatggacgatatggggtggggtgacctgggcgtgtatggtgagccatctcgagagacgcccaaccttgatagaatggcagcagaggggctcttgttccctaatttttactccgctaatccattatgcagccctagtcgcgcagccttgctgactggaaggttgccgatccgtaacggattttataccaccaacgcacatgctagaaacgcatatacaccccaagagattgtgggcggcatcccggatagtgaacaactgctccccgaactgctgaagaaagcgggatacgtctccaagatagtgggaaagtggcacctgggacataggccgcagttccaccccctgaagcacggctttgacgaatggtttgggagcccgaattgtcacttcggaccttacgacaataaggccaggccgaacattcccgtctatagagactgggagatggtgggacgttactacgaagagtttccaataaacctgaagacaggagaagcaaatctcacccagatatacctccaggaagctttggatttcatcaagcgccaggcaagacatcatcccttttttttatattgggcagtggacgccacgcatgctcctgtgtatgcctcaaagccctttcttgggacttcacagcgtggccgctatggggacgccgtccgcgaaatagatgattccatcggtaagatcctggaattactgcaagacctccatgtggcagataatacctttgttttctttacatcggataacggtgctgctctcatttccgctcccgaacagggaggatctaacggcccattcctgtgcgggaagcagaccacctttgaggggggaatgcgagaacccgcactggcgtggtggcccggacatgtcacagccggacaggtgtcccaccaattaggcagtattatggatctcttcactacaagtctggccctggctggtctgacacctccctctgacagggctatcgacggcctgaaccttctgcctaccctcctacaaggccgtttgatggaccggcctatcttttattacaggggagatactctgatggccgccaccctggggcagcataaagcccacttctggacctggaccaatagttgggagaattttcgccagggaattgacttttgtccaggccagaatgtctctggggtaaccacccataatctcgaagaccatactaagcttcctctgatattccatctggggagagaccccggggaacgtttcccgctctccttcgcatccgccgagtatcaggaggcgctgagccggatcaccagcgtcgttcaacaacaccaggaggccttggtgccagcccaaccacaactgaacgtctgcaattgggcagttatgaactgggccccacccggatgtgagaagctcgggaagtgcttaacaccgcccgagagtatccccaagaaatgcctctggtcacattag

SEQ ID NO: 2517 - DNA, 261 bp, Artificial Sequence
  Description of Artificial Sequence: Synthetic coding sequence
atggcagctgtggtggccgccacaagatggtggcagttgctgttggtcctgagcgccgctggcatgggagcctctggtgcgcctcagccacccaatattctgttgcttctcatggatgacagaggtcgccattgttcgcaagacgggtaccccagtgccatggcctccacgccacctactccaatgccagagactcccactcaccgtcgtcgattatgggccgcttcccagacccgcagttcttcctgccggtctttttag

SEQ ID NO: 2518 - DNA, 1344 bp, Artificial Sequence
  Description of Artificial Sequence: Synthetic coding sequence
atggcagccgtggtggcagccaccagatggtggcagttgctgttagttcttagcgccgcaggaatgggggcctccggcgcaccagggcagagggcttataccccccaggagatcgtaggggggattccagattccgagcaactgttacctgagctcctaaagaaagccggttatgtgagtaaaatagtagggaagtggcatcttgggcacaggcctcagttccatcccctgaaacacggcttcgatgagtggtttgggagccctaactgccatttcggaccttatgacaataaagcccggcccaacataccagtgtaccgagactgggaaatggtaggtcggtattatgaggaattcccaattaacctgaagactggggaagccaacctgacccaaatatacttgcaggaagccctggacttcatcaagagacaagcccgccaccacccattctttctgtattgggcagttgatgccacccacgcccccgtatacgcttccaagccgttcctgggcacttctcagcggggtcggtacggggatgctgtgagggaaatcgacgacagtataggtaagatcctcgaattgcttcaggatctgcatgtggccgataatacgttcgttttttttacgtcagacaatggagctgctttaatctcggcccccgagcagggagggtcaaacgggcccttcctttgtggaaagcagacaacattcgaggggggtatgagagagcctgctcttgcttggtggcctgggcacgtgacagcaggccaggttagccaccaactggggagcatcatggatctgttcactacaagtttggccctcgcggggctgactcctcctagtgatcgcgcaatcgacggtctgaacctgctgccaacactgctgcaagggagactgatggacagacctattttctattaccgaggagacactctaatggcagccacgttggggcagcataaggctcatttctggacgtggactaactcatgggaaaatttcagacagggtatcgacttttgccctggccagaatgtgtccggggtcaccacacataacctggaagaccacaccaagctcccactcattttccatctgggtcgggatcccggggaaagatttcctctgtcattcgcatccgccgaataccaggaagccctgtcgcggatcacaagtgttgtccagcagcatcaggaagccctggtcccagcccagcctcaactgaacgtgtgcaattgggccgtgatgaattgggctccccccggctgtgagaagttaggaaagtgcctgactccgcctgagtcaatacccaaaaagtgcctgtggagccattag

SEQ ID NO: 2519 - DNA, 1140 bp, Artificial Sequence
  Description of Artificial Sequence: Synthetic coding sequence
atgagtaggagtggaaccgacccccagcagaggcagcaggcaagtgaagccgacgctgccgccgccacgtttcgggcaaacgaccatcagcacattagatataatcccctacaagatgaatgggtgcttgtctcagcccatcggatgaagcgaccctggcagggccaagtggagccacagctcctgaaaacggttccacggcacgacccccttaatccactgtgtcccggtgcgatccgggccaacggagaagttaaccctcagtacgacagtacatttctgttcgataatgactttcctgcactgcagcctgatgcaccaagccccggccccagtgatcacccactgtttcaggcaaagtcagcgcggggggtctgcaaggttatgtgcttccacccatggtctgatgtcaccctgcccctgatgtctgtccctgaaatcagagctgttgtcgacgcctgggctagtgtgactgaagaactaggcgcccagtatccttgggtgcagatattcgagaataagggtgcaatgatgggctgctctaacccacatccacactgccaggtgtgggcttcttcatttctgccagatattgcacagagggaggagcgatctcaacaggcgtacaagtctcagcacggagagcctctcctgatggaatattctcgccaggagctgttgagaaaagaacggctcgtgctgacttctgagcactggctcgtgttggtgccgttctgggctacctggccctatcagaccctgctgttaccccggcggcacgtcagacggctgccagaactaactcctgctgagcgggacgacctcgcctcgattatgaagaagctgctcaccaaatatgataatctgttcgaaacctctttcccttacagtatgggctggcatggggcccctaccggctctgaggccggggccaactggaatcattggcagttacacgcacactattacccacctttgcttaggagtgccaccgtccggaaattcatggtcgggtacgaaatgctggcacaggcgcagcgcgatctcacccctgaacaggctgccgagcgcctgcgtgctctgccagaagttcactatcatctcggacagaaggatagggaaactgccaccattgcctag

SEQ ID NO: 2520 - DNA, 813 bp, Artificial Sequence
  Description of Artificial Sequence: Synthetic coding sequence
atgaccctgagtaccctgtgtgttctagggccatccgaacccactgagagcaaagtgatgtgctttcacccttggtcagacgtgactctgccccttatgagcgtgccggagatccgcgccgttgtggacgcctgggctagcgtcaccgaagaactgggcgcccagtatccatgggttcagatcttcgagaataagggggctatgatgggttgtagcaatccccatccccattgccaggtgtgggctagctctttcttaccagacatcgcccagagagaggagcgaagccagcaagcttataagtctcaacatggagagcccctgctgatggagtattctaggcaggagctgctaaggaaagagaggcttgtcctaacctccgaacactggctggttcttgtgccattctgggccacgtggccctaccaaactttactgctgccaagaaggcacgtaagaaggctgcctgagctgacacccgcggaacgagatgacctcgcttcaatcatgaaaaagttgctgaccaaatatgacaacctgtttgagacttcatttccctactcaatgggatggcacggcgccccgaccggctcggaggctggcgccaactggaaccactggcagctgcacgctcattactaccctcccctcctgcgctctgccactgtgcggaaatttatggtaggttacgaaatgttagcccaagcccaacgcgatttgacccctgagcaggctgccgaacggctccgcgccctgcctgaagtccactaccaccttggccagaaggaccgcgagacggccaccatcgcctag

SEQ ID NO: 2521 - DNA, 255 bp, Artificial Sequence
  Description of Artificial Sequence: Synthetic coding sequence
atgagccgatcaggtacagatcctcagcaacggcagcaggcttccgaggctgatgccgcggcagccacctttagggctaacgatcatcaacacattaggtataatcccctgcaggacgaatgggtgctggtgtctgctcataggatgaagaggccatggcagggccaagtagagcctcagctgctcaagacagtcccacgccatgatcccctcaatccattgtgccctggtgccatcagggcgaatggcgagtag

SEQ ID NO: 2522 - DNA, 2229 bp, Artificial Sequence
  Description of Artificial Sequence: Synthetic coding sequence
atgagccctcagaagcgcgtcaagaacgttcaggcccagaacaggacgtcccagggcagttccagcttccaaacaacactgagtgcctggaaggtcaagcaggaccccagcaactcaaaaaacatcagtaagcatgggcagaacaacccagttggtgattatgagcacgctgacgatcaggccgaggaggatgccctgcagatggccgtagggtacttcgagaagggcccaattaaagcgtcccagaacaaagacaagactctcgaaaaacacctgaagaccgtggaaaatgtggcctggaaaaacggcctagcaagtgaggagatcgacatcttgctcaatattgccctgagtggtaaattcgggaacgccgtgaataccaggattcttaagtgcatgattccagctaccgtcatttccgaggatagtgtcgtgaaggccgtatcctggctgtgtgttgggaagtgttctggcagcactaaggtcctgttctatcgatggttggtagccatgttcgacttcatcgatagaaaggaacagattaatctactttacggtttcttttttgccagcctgcaggatgacgcgctgtgcccctatgtttgccatcttctctatcttttgaccaagaaggaaaacgtgaaacctttccgcgtgagaaagctcttggacctgcaggcaaaaatgggaatgcagccccatttacaggcactgcttagcttgtataaattctttgctcctgcactaatctcggtttctctgccagtcaggaagaaaatttactttaaaaacagtgaaaacttgtggaagacagctcttctggcagtgaagcaacgcaatagaggtccttctccagagccgctgaagcttatgctgggaccagccaatgtccgtcccctgaaacggaagtggaattcactctccgtgattcccgtgctgaactcgagctcctataccaaggagtgcggcaagaaagagatgtctttgtccgactgtctgaacagaagcggatcatttccactggagcagcttcagtcctttcctcagctcttacagaatatccattgcctcgaactcccgtcccaaatgggaagcgttctcaacaattctctcttgctgcattacatcaattgtgtccgtgacgagcccgtgctcctccgtttctattactggctgtcccagaccctgcaagaggagtgcatttggtataaagtaaataactatgaacatggtaaagaatttactaacttcctagatacgattatccgggctgaatgctttcttcaggagggtttttacagctgcgaggcatttctttacaagagcctgcctctgtgggatggcctgtgttgtaggtcacagttcctgcagttagtgagctggattcccttttcgagtttctcagaggtgaagccactgctatttgatcacctcgcacagctgttttttaccagtacgatctacttcaaatgctcggtgctgcagagcctcaaggagttgcttcaaaactggctgctctggctgagtatggacattcatatgaagcctgtgaccaactctccactggagacaactttagggggtagcatgaatagcgtgtcaaaacttatccattacgtcgggtggctgtcgacaacagccatgcgcctggaaagcaacaatacttttctgttgcactttatcctcgacttctacgagaaggtgtgcgatatctatattaactataacttacccctggtagtgctttttcctcccggaatcttctattctgcactgctgagcctggacaccagcatactcaaccagctttgtttcattatgcatcgctacagaaagaatctcacagcagccaaaaagaacgagctagtgcaaaagaccaagagtgagtttaatttctcttcaaaaacttatcaggagtttaatcactatcttaccagtatggtgggctgcttgtggaccagcaagccttttggcaaaggcatctatatcgaccccgaaatactcgaaaagactggcgttgccgaatataagaactccctgaacgtcgtgcaccatccctctttcctgtcatacgcggtatcttttctgctccaggggaagaagtggagctggtatctagattacttgtttagtcagggcctccaaggtctgaagctctttatcagatcctcagtacaccactcaagtatcccccgcgctgagggaattaactgcaacaaccagtattag

SEQ ID NO: 2523 - DNA, 636 bp, Artificial Sequence
  Description of Artificial Sequence: Synthetic coding sequence
atgaagctatgggacgtagtagctgtctgtctcgtgcttttgcacacagcctccgcattccccctgccagccggcaagcgcccccccgaggccccagcagaagaccgatccctcggcagaaggagagctcctttcgctctgtctagcgatagcaatatgcccgaggactatccggaccaattcgacgacgtaatggacttcatacaggccacaatcaagcgcctcaagcgatcaccagacaaacagatggctgtgctgccaagaagggaaaggaaccggcaggcagcagctgccaaccccgagaactccaggggtaaggggaggcgggggcaaaggggtaaaaataggggctgtgtgctgacggccatccacctgaacgtaacagatctgggactgggctatgaaacaaaagaagagctgatttttagatactgttccggatcatgtgacgccgccgaaaccacatatgataagattctgaaaaatctgagccggaatcgacgacttgtgagcgataaggtgggacaggcctgttgtaggccaatcgctttcgatgacgacctctcctttttggatgataaccttgtatatcatatcttacgaaaacactccgcaaagcgctgtggctgcatctag

SEQ ID NO: 2524 - DNA, 558 bp, Artificial Sequence
  Description of Artificial Sequence: Synthetic coding sequence
atgaagctttgggacgtcgtagcagtctgcctggtgctcctacacaccgcttccgcgtttccgttacctgctgccaacatgccggaggattaccctgatcagtttgacgatgtgatggatttcatccaagctacaattaagcggctgaaaagaagtcctgataagcagatggccgtgctgcctcgcagggagcggaacaggcaggccgctgcagcaaatcccgagaattcacggggcaaaggaagaagaggccagagaggtaaaaaccgcggctgcgtgctgaccgcaatacatctcaatgtgacggatctaggcttgggatacgagaccaaagaagaactcattttccgttactgtagcggatcttgtgacgccgctgaaactacatacgataagatcctgaaaaacctaagccgcaatcgacgactggtgtccgacaaagtcggccaggcctgctgtagaccgatcgcctttgatgacgatctgtccttcctggacgataatttggtctatcatattctcagaaagcattcggcgaagcgatgcgggtgcatctag

SEQ ID NO: 2525 - DNA, 687 bp, Artificial Sequence
  Description of Artificial Sequence: Synthetic coding sequence
atgcagtcccttcctaactctaatggagctgccgccggcagagattttaagatgaaactgtgggacgtggtcgccgtgtgtctggtgttactacataccgcaagcgctttccccctgcctgcaggcaagcgacccccagaggcacctgccgaggatcgatccctggggcgtaggcgagcgccttttgccttgtctagcgactccaatatgcctgaagactatccagaccagtttgacgatgtcatggatttcattcaggcaaccatcaagcggttgaagaggagcccagacaaacaaatggctgtcttgccacgtagggagcggaacaggcaggccgccgccgcaaacccggaaaattcacgaggaaagggaaggagggggcagcgtggtaagaaccgcggctgcgtgctcaccgcgatacacctgaacgtgacagatctcggtttagggtatgagacaaaggaggagctgatattccggtattgctccggcagctgcgatgcggcagagactacttatgacaagatcctcaagaacctctcacggaaccggaggctcgtgtctgacaaagtcggtcaagcatgttgccgccccatcgcattcgatgatgatttaagcttcctcgatgacaacttagtgtaccatatcctgcgtaagcatagcgcgaagcggtgtggctgcatctag

SEQ ID NO: 2526 - DNA, 186 bp, Artificial Sequence
  Description of Artificial Sequence: Synthetic coding sequence
atgaaattgtgggacgtggtcgccgtttgcctggtgctcttacatactgcttcggccttccccttgcccgccgccaatatgcccgaggactacccagaccaatttgacgatgtgatggatttcatccaagccacaatcaaacgccttaaaaggtcccctgacaagcagatggccgttctgccatag

SEQ ID NO: 2527 - DNA, 186 bp, Artificial Sequence
  Description of Artificial Sequence: Synthetic coding sequence
atgaagctttgggatgtggtggctgtgtgtttggtcctcttacacaccgcttcagcgttccccttgcccgccgcgaacatgccggaggactacccagaccaattcgatgatgttatggattttatccaggctaccatcaagcggctcaaaagatccccagacaaacagatggctgttctgccatag

SEQ ID NO: 2528 - DNA, 558 bp, Artificial Sequence
  Description of Artificial Sequence: Synthetic coding sequence
atgaagctctgggatgttgtcgccgtatgcttggttttactgcacactgcttcagcttttccgctgcctgcagcgaatatgcctgaagattaccccgaccagtttgatgatgtcatggatttcatccaggctaccattaaacgcctgaaaagatccccagacaagcagatggcagtccttccccgcagagagaggaatcggcaggctgccgcagcaaatcccgagaattctagaggcaagggaagacgaggacagcgcggcaagaatagggggtgcgtgctgaccgccatccatctgaacgtcaccgacctgggcctcggctatgagactaaggaagaactgatctttagatactgttcaggatcttgcgatgcggctgagactacttacgacaaaatactgaagaatctcagtaggaatagacgcctcgtgagcgataaggtgggtcaggcatgttgtcgtcccatcgcgtttgatgacgatctgagcttcctggacgacaacctggtgtaccatatactccgcaagcacagcgcaaagcggtgcggctgtatctag

SEQ ID NO: 2529 - DNA, 609 bp, Artificial Sequence
  Description of Artificial Sequence: Synthetic coding sequence
atgcagtcacttcctaactcgaatggcgcagcagccggccgtgacttcaaaatgaaactatgggacgtggtggcggtttgcttggtgctcctccacacagcctcagcatttccactgcctgccgctaacatgccagaagactaccctgatcagttcgacgatgtcatggacttcatccaggcgacgatcaagcggctgaagcgctcccctgacaaacagatggcagtcttgccccgtcgggaacggaacaggcaggccgccgccgcgaatccggagaattctcgcggcaagggaagacgtggtcaacggggcaagaaccgaggctgtgtactgactgccatccacttaaatgtcacagacctgggactcggatacgagacaaaagaggagttgatcttccgctattgcagcggttcatgtgacgccgccgagaccacatacgataaaatcctgaagaacctgagtcgcaaccgacgcttagtgtcagataaagtgggccaggcctgctgtaggcccatagcttttgatgatgacctgtccttcctggatgataatttagtctaccatatcctgagaaaacattcagcaaaaaggtgcgggtgcatctag

SEQ ID NO: 2530 - DNA, 543 bp, Artificial Sequence
  Description of Artificial Sequence: Synthetic coding sequence
atgaagagtatctatttcgtggccggcttgttcgtaatgctggttcagggatcatggcagcggtctctgcaagacacagaggaaaaaagtaggagtttctcagcttcccaggcagatccattgtctgacccggatcaaatgaacgaggataagcgccattcacaggggacatttacttccgactattcaaagtacctggatagccgccgggcacaggacttcgtccaatggctgatgaacaccaagcgcaacagaaataatatcgcaaaaagacacgatgaattcgagcgccacgctgaaggtacatttacaagcgatgtcagcagctatctggaaggccaggctgctaaagagtttatagcctggttagtgaagggccgtggaaggcgcgatttccccgaggaggtggcaatcgttgaagaacttggcagacggcatgcggatggaagtttttctgatgagatgaacacaatcctggataacctagccgcacgggacttcattaattggttgatccagacgaagatcactgataggaaatag

SEQ ID NO: 2531 - DNA, 543 bp, Artificial Sequence
  Description of Artificial Sequence: Synthetic coding sequence
atgaagtcaatttatttcgttgctggcctgttcgtgatgctggtccagggctcctggcaaaggagcttgcaggatacggaggagaagtctcgctctttttcagcttcccaggccgaccccctctctgaccctgatcaaatgaacgaagacaagcgtcatagccagggcacattcacgtcagattattctaagtacctggacagtcgtagagcccaggactttgtgcaatggctgatgaatacaaagcgaaacagaaataacatagctaagcgccacgatgagtttgaacgacacgctgaaggaacatttacgtctgacgtttccagttatttggagggacaggccgcaaaagagtttattgcctggcttgtgaaagggcgtgggcgacgcgatttcccagaggaagtcgctatcgtggaggagctggggaggcgccacgcagatggctctttttctgacgagatgaacacaatcctcgataatctggccgctagagacttcattaattggctcattcagacaaagataaccgataggaaatag

SEQ ID NO: 2532 - DNA, 2262 bp, Artificial Sequence
  Description of Artificial Sequence: Synthetic coding sequence
cgggcacccgaccgccggggaagcccacgcttggcatcgacccgactgggggcactacgcctgaggcccagtaggcgggtacctgctagagccccggcccctgctcaggctcccctgcccctaggaccgcggttattaggcctgcgaaggaacatggccgcccctatgacgccagccgcccggccagaggattacgaggccgccttaaatgcagctcttgcggacgtcccggaattggctcgcctgttggagattgacccttatctgaaaccctatgctgttgacttccagcgccggtataaacagttcagtcagattcttaaaaatattggcgagaacgaaggtgggatcgacaagttttctcgaggatatgagagcttcggtgttcaccgttgcgcagacggcgggctgtattgcaaggagtgggcaccaggagctgagggtgtttttctgactggggattttaacggatggaatccatttagttatccatataaaaaactggactacgggaagtgggaactgtacatacctcccaaacagaataaaagcgtgctggtgccacacggatccaagttaaaagtcgtgataacttctaagtcgggggaaattttgtacagaatttccccttgggcaaaatacgtggtgcgcgagggagacaacgtgaactatgattggatccactgggatcctgagcactcctacgagtttaaacacagccggcctaagaagccaagatccctgcggatctacgaatcgcacgtgggtatctcttcacatgaagggaaagtagcctcttacaagcattttacatgcaatgtcctcccacggataaagggcctgggatataattgtatccagctgatggccataatggagcatgcatattacgcttcattcggctatcagattactagtttctttgcagccagctcccgctacggaacccccgaagaactgcaggagttggttgacactgctcattccatgggtattatagtcctcctcgacgtggtgcacagccatgcttctaagaacagcgccgacggtctcaatatgttcgacgggactgactcttgctattttcatagcgggccccgaggtactcacgatctatgggactcacgtttgttcgcgtactcatcatgggagatcctgcgttttttgctgtctaacatccggtggtggctggaagagtaccgcttcgatggcttccggttcgatggcgtcacctctatgctttaccaccatcacggggtgggccagggcttctcaggcgattactcagagtattttggtctccaagtggatgaggatgctcttacatacttaatgcttgccaatcatttggtccacacactgtgtcccgatagcataacaattgcagaggacgttagtgggatgcctgccttgtgctcaccaattagtcagggcggcggaggctttgactatcggttagcgatggcgatccctgataaatggattcagctgctcaaggaatttaaggatgaagattggaacatgggcgacatcgtttacacgctcacaaaccggcgatatctcgaaaagtgcattgcctacgcagagtcacatgatcaggctttagtgggcgacaaaagcctcgccttctggctgatggatgcagaaatgtacaccaatatgagtgtactgaccccgttcacacccgtgatcgatcgcggaattcagctccataagatgataaggctgatcacccacggcttgggcggggagggctacctgaattttatgggaaacgagtttgggcatcccgaatggttagattttccacgaaagggaaacaatgagtcgtatcattacgcgcggcgccagttccatctcaccgatgatgatctattacgttacaagttccttaataacttcgaccgcgacatgaacaggctggaagaaaggtatgggtggctggcagctccacaagcttatgtctctgagaaacacgagggcaacaagattatagcattcgagcgagcaggcttgctattcatttttaactttcatccgtcgaagtcatatacagactatcgagtcggaaccgccctccccggcaagttcaaaatcgtgctggatagtgacgctgccgagtatggcggacatcaaaggctcgaccacagtaccgacttcttctccgaggccttcgaacataacggcagaccctatagcctcctcgtgtatatcccaagccgcgtcgcgttgattctgcagaatgttgacttgccaaattag

SEQ ID NO: 2533 - DNA, 2109 bp, Artificial Sequence
  Description of Artificial Sequence: Synthetic coding sequence
atggctgcccccatgacaccagctgcaagaccagaagattacgaggccgctctcaacgccgccctggcagacgtgcctgagctcgcacgactcctcgaaatcgatccctacctgaagccgtacgcagtcgacttccagcgaaggtacaaacagttttcacagatcctcaagaatattggcgagaatgaaggaggtatcgacaaattcagcagaggctatgagagcttcggcgtgcacagatgtgccgacggcggcctttactgcaaagaatgggcacctggtgcagagggcgtgttcctgactggggactttaacggatggaatcctttctcatacccgtataaaaagttggattatggcaaatgggagctgtacatccccccaaagcagaacaagtctgtgctcgtgccccatggatccaaacttaaagtagtgatcacatccaagagcggcgagattctgtatcgcattagcccttgggccaaatacgtggttcgtgagggtgacaatgtcaactatgattggatacactgggaccctgagcactcctatgagtttaaacactccagaccgaaaaagccacgatccctccggatttacgagagccacgtaggaatctcctcccatgagggcaaggtagcctcctacaaacacttcacatgcaatgtgctgcctcgtataaaggggcttggttacaattgcatacagttgatggcaataatggagcacgcatattacgccagtttcgggtatcagatcactagcttcttcgctgctagctctcgctatggcactcctgaagaactgcaggagctcgtggatactgctcacagtatgggtattatagtgttgctggacgtggttcacagtcacgccagcaaaaattctgccgatggtctgaacatgtttgatggaacggactcgtgctactttcattcaggcccacggggcacccacgatctgtgggattcacgactgtttgcctattccagctgggagatacttcgatttctgctcagtaatataagatggtggctggaagagtatagattcgacggcttcagatttgacggcgtaaccagcatgctctaccaccaccacggcgtggggcagggttttagcggggactattccgagtattttggtctgcaggtggacgaggacgccttaacgtatctgatgttggcgaatcaccttgtgcacacgctgtgcccagacagtatcaccattgcagaagatgtgtccgggatgcctgccttgtgttcccctatcagtcagggtgggggaggcttcgactacagactcgccatggccattcccgataagtggatccagttgctgaaggaattcaaggatgaagactggaacatgggcgacatcgtttatactttgaccaatcgtcgttatttggagaaatgcatagcctatgctgaatcacatgaccaagcactcgtcggcgacaaatcgttggcattctggctcatggatgccgaaatgtatacgaatatgagcgtccttaccccctttaccccagtgatcgaccgtggcattcaactccacaaaatgattcggcttatcacacatgggctcgggggagaaggctacctgaattttatgggaaacgagttcggacatcccgagtggctggattttcctaggaaggggaacaacgaaagttaccactatgcccgccggcagtttcacctgaccgacgatgatctgctgaggtataaattcctcaacaactttgaccgcgatatgaacagattagaggagcggtacggttggttggctgctccacaggcctacgtatctgagaagcacgagggcaacaagattatcgccttcgagcgcgccggcctcttattcatcttcaactttcatccatctaagagctatacggattaccgcgtcggtacggccctccccggtaagtttaagatcgtgttagatagtgacgcagccgagtatggggggcatcagcgtcttgaccattcgaccgatttcttttcagaagccttcgaacacaatggccgcccgtactccctcctcgtgtatataccatcccgcgtggcattgatcctgcagaacgttgacctgcccaattag

SEQ ID NO: 2534 - DNA, 1398 bp, Artificial Sequence
  Description of Artificial Sequence: Synthetic coding sequence
atggcgattatggagcatgcttattacgcatcatttgggtaccaaatcactagtttcttcgccgcgtcaagccgctacggcaccccggaggaacttcaggagttagtcgacactgctcattcaatgggcatcattgtacttttggatgtggtgcactcacacgcatcaaagaatagcgccgatgggttaaatatgttcgacggtacagatagttgttactttcattctggcccaagagggactcatgatctgtgggactctcggttgttcgcctattcctcatgggagattctacgcttccttctttccaacattagatggtggctggaagaatatcgtttcgacgggttcaggttcgacggggttacttctatgttataccaccaccacggagtcggacaaggctttagcggcgactactctgagtactttggccttcaggtagacgaagacgctctgacatacctcatgctggccaaccatctagtgcacactctgtgccccgatagcattaccatcgccgaagacgtgtccggcatgccagcactctgtagtcctatttcacagggcggcggcggctttgattacaggctggcaatggccattcctgataaatggatccagcttctgaaggaattcaaggacgaggattggaacatgggcgatatagtatacacactcactaaccgtcggtatctggagaagtgcattgcgtatgcggagtcacatgatcaagctctggtcggggacaagagcctggccttctggctcatggacgcagagatgtataccaacatgtctgttctaaccccctttactccagtgattgacaggggtatccagttacacaagatgatccggctgattacacacggtctcgggggcgaagggtacctgaactttatgggcaatgaattcggacatccggaatggctggattttccacgcaagggaaacaacgaatcctatcattatgccagacgccagttccatcttaccgacgacgatctgctgcggtacaagtttcttaacaacttcgaccgggatatgaatagattggaggaacgatacggttggctggcggcccctcaagcttacgtgagtgaaaagcacgaaggaaataagataattgcattcgaacgggcagggctcctgttcatctttaattttcatccaagtaagagctatactgactatcgggtcggcacggccctgcctggtaagtttaagattgtcctagacagcgatgcggccgaatacggagggcaccagaggctggaccatagtactgactttttttccgaagccttcgagcataatggacggccgtacagcttgttggtctacataccctccagggtggccttgattctccagaatgtcgacttaccaaactag

SEQ ID NO: 2535 - DNA, 1074 bp, Artificial Sequence
  Description of Artificial Sequence: Synthetic coding sequence
atggaggaaggcatgaatgtgctccacgatttcggaattcaatccactcattaccttcaggtcaactaccaagacagtcaggactggttcatcctggtgagcgtgatcgctgacttacgcaatgccttctacgtacttttccctatctggtttcatcttcaggaagctgtgggtatcaagttactttgggtggctgtgattggggattggctaaatctggtcttcaaatggatcctatttggccaacgcccatattggtgggttctggacaccgattactattcaaacacctctgtccccctgattaaacagtttccggttacatgcgagactggacccggttccccaagcggccacgccatgggaaccgccggcgtgtactacgtgatggtgacaagcaccctttctatcttccaaggtaaaatcaagccaacctaccggttccgctgtctgaatgtaattctgtggctcggattctgggcagttcaactaaatgtttgcctgtcacggatctacctcgcagcacacttcccccaccaagtggtggcgggcgtgctgagtgggattgccgtggcagaaacgttttcccacattcacagcatatacaacgcctccctgaaaaagtattttttgatcactttcttcctgttttcctttgctattggattctatctgctccttaagggactgggcgtggatcttctgtggactctggagaaggctcagcggtggtgtgaacagcctgagtgggttcatatcgatacgacccccttcgcttccctcttgaagaatctcggtacgttgtttggcctaggcctggcccttaattcttctatgtaccgagagtcgtgcaaaggaaagttaagcaagtggctgccatttcgcctgagcagcatcgtcgcctcccttgtgcttctgcatgtgttcgacagcctcaagccccccagccaggtcgagctagttttctacgtgctgtctttctgtaagagtgccgtggtccccctggcctccgttagcgtaattccctattgcctcgcgcaggtgctagggcagccccacaaaaaatccttatag

SEQ ID NO: 2536 - DNA, 2859 bp, Artificial Sequence
  Description of Artificial Sequence: Synthetic coding sequence
atgggagtgcggcacccaccatgctcacaccggctactcgcggtttgcgccctcgtcagcttggctacggccgcgctgctcggacatatcctcctgcatgattttctgctggtcccccgggaacttagcggcagttccccagttctggaggaaacccaccctgctcaccagcagggggcatctcgcccagggccaagagatgcacaggcccaccccggccggccacgcgctgtgccaacccagtgcgacgtgccgcccaatagcaggtttgattgcgcccctgataaggctatcactcaagagcagtgcgaagcgaggggttgctgctatatcccagccaaacagggtctacagggcgcacagatgggacagccgtggtgcttttttccgcccagttacccatcttataaattagagaatctgtcctcatcagaaatgggctataccgccaccttgactcggaccacccctacattcttcccaaaagacattctgaccttgagattggacgtgatgatggagaccgaaaatagactgcatttcaccatcaaggaccctgcgaatagacgctacgaggtccctctggaaactcctcatgtccatagccgcgcccctagccccctctatagcgtggaattctctgaggagccttttggtgtaattgttaggcggcagttagacggccgtgtgctcctgaacactacagtggcgcctctgttctttgccgatcagtttctgcagttaagtacaagcttaccttcccagtatatcacaggactcgcagagcatctgtcaccgcttatgctgagcacatcgtggacaagaatcacgttgtggaaccgggatctggcaccgacccccggtgccaacctgtatggatctcatccgttctatctggccctcgaagatggagggagcgcacacggcgtcttcctgctcaatagtaacgccatggatgtggtgctgcagcccagccctgccctgtcatggcgatcaaccgggggaatactggacgtgtatatttttctggggcctgagccaaagtcagtggtgcagcagtacctggacgtggttggctacccatttatgccaccctattggggcctgggcttccacctctgccggtgggggtactccagcactgctattacccggcaggtagtagagaatatgacccgggctcacttcccgctcgatgtccagtggaatgacctggattatatggactcacgacgtgactttacgttcaataaggatggcttccgagatttcccagcgatggtacaggagctgcatcaggggggccgacgttatatgatgatcgtggaccccgcaatcagtagttcaggccctgccggctcatacaggccctacgatgagggtctccggaggggtgtgttcattactaacgagacaggccagccacttattggtaaagtatggccaggatctacagcctttcccgactttaccaatccgacggctctggcctggtgggaggacatggttgctgagttccacgatcaggtgccctttgatggcatgtggattgatatgaacgagcctagcaatttcatccgaggaagcgaagatggctgtccgaataacgagctcgagaaccctccctacgtcccaggggtcgtaggcggcactttgcaggctgccactatctgtgcgtctagccaccagttcttgagcacacattataatttgcataatctgtatgggcttacagaggctatcgcgtctcacagggcccttgtgaaggcgcgcgggactcgtccctttgtgattagcagatccacatttgcaggacatggccgctacgctggacactggacaggagacgtttggtcttcttgggagcagctggcctcatccgtccccgagatcctgcagtttaatctcctcggggtacccttagtcggcgcagacgtttgcggttttctgggcaatacaagcgaggagctttgtgtaagatggactcagctcggtgcattctatccttttatgcgcaaccataactcgctgctgtcgctcccgcaagaaccgtactcattctcagagcccgcccaacaggcaatgaggaaagcactgacccttcgatatgctctcctcccccatctgtacacattattccaccaggctcatgtcgctggggaaactgtggccagaccactctttttagaatttcctaaagattcatccacctggactgtggaccaccaactgttgtggggggaggctctgctgatcaccccagtgttacaggcaggcaaagcagaggtgactgggtattttccccttggaacatggtacgacctgcagaccgtcccagtggaagcgctggggtccctgcctccaccccccgctgcaccccgtgaacccgctatccacagtgagggccaatgggtgactttgccagcccctttggacacaatcaatgtccacttaagagctggctatatcatcccgctgcaagggcccgggctgaccactaccgagtctaggcaacagcctatggcgcttgctgtagccctaacaaaggggggggaggcgcgtggagagttgttttgggatgatggcgaaagcttagaagtccttgaacgaggagcttacacccaggttattttcttggccagaaacaataccatagtcaatgaattagtcagggtcacatctgagggcgctgggctgcagctccaaaaggtcaccgtactgggggtggccacggcaccccagcaggtgctgtctaatggcgtgcccgtctcaaacttcacttacagtcctgatacgaaagtattagacatctgcgtcagcctcctcatgggcgagcagttcctcgttagttggtgttag

SEQ ID NO: 2537 - DNA, 2859 bp, Artificial Sequence
  Description of Artificial Sequence: Synthetic coding sequence
atgggagttagacatcccccgtgttcgcaccgtttgctggccgtgtgtgccctcgtttctctggcaacagctgcgttgctcggacatattctgttacacgacttccttcttgtccctcgtgagctgtctggaagcagcccggttctcgaagagactcatcccgcacaccaacaaggcgcttcacgccccggccctcgcgacgcccaggctcaccccggtcgtccccgcgccgtgccaacacagtgcgatgtgccgcctaattcccgctttgattgcgctcctgacaaggctattactcaggaacaatgtgaggccagggggtgctgttacatccctgctaagcaaggtctgcagggcgctcaaatgggccagccatggtgttttttccccccatcatatccatcttacaagctggaaaatctaagttccagcgagatgggatacacagcaacactaactagaaccactccaaccttttttcctaaagatatattgactctcaggcttgacgttatgatggagacagagaacagactgcattttacaatcaaggatccggccaatcgtcggtacgaggtgccacttgagacacctcatgtccactcccgggcaccgagccctttatattcagtcgaattttcagaagagccttttggcgtgattgtccgaagacagctggacggccgggttctattaaatacaaccgtcgctcccctcttctttgctgatcagtttctgcaactgtctacgagtctcccaagccagtacattacaggactggctgaacacctgtccccactgatgctgtcaacttcctggacccgtattacgctctggaaccgggacttagcgcctacccccggggccaatctctatggttctcaccctttttatctggcccttgaagatggtggtagtgcccatggtgtctttctgctcaacagtaatgccatggatgtcgtgctccaaccctccccggctctcagctggcgctcaaccggcggcattctcgatgtttacattttcctgggccctgagccaaaatcagtggtgcagcagtatttggacgtggtcggttacccattcatgccaccttactggggactcggatttcacttgtgcaggtggggctattcaagcaccgcaatcacaagacaggtggtcgagaacatgacgcgcgcccatttccctctggacgtccagtggaatgacctggactatatggacagtaggcgggacttcacatttaacaaagatgggtttagagactttcccgcgatggttcaggaactacatcagggggggagacgatatatgatgatcgtggatcccgccatctcttctagcggccctgccggctcctacagaccgtacgatgaaggcctgagaaggggcgtgtttatcacaaacgagacaggacagcccctgataggcaaggtttggcccggctccaccgccttccccgatttcacaaaccctacggcgttagcctggtgggaagacatggtggccgaatttcatgaccaagtgcccttcgatggcatgtggatcgatatgaacgagccatcaaattttataagaggcagcgaagacggctgccccaataatgaactagaaaaccccccatacgtgcctggcgtcgtgggtggtactcttcaggccgccactatctgcgcctcctctcatcaatttctgtcaacccactataatctgcacaacttgtatggactgacggaggctattgctagccaccgcgcactggttaaggcccgtggcactcggccttttgttatctcgcgtagcacctttgccggccatgggagatatgcagggcactggacgggggatgtctggtcatcgtgggagcaactcgcatcctcggtccctgaaattctgcagttcaacctcctcggggtgcctctggtgggggctgacgtctgcgggttcctgggtaacacaagtgaggagttgtgcgttcggtggacccaactgggcgcgttttacccgttcatgcggaaccacaactctctcctatcactgccacaggaaccgtactcattcagtgagcctgctcagcaggcgatgagaaaggccctcactctgcgctatgccttgctcccgcatctctataccttgttccaccaggcacacgttgccggagagactgtggctcgtccactgttcctagagttccccaaagatagctcaacctggacggtggaccaccagctgctctggggcgaggcactgctaattacccctgtactgcaagcagggaaggccgaagtgactggctattttcctcttggtacctggtatgaccttcagacagtgcctgtggaagccctggggagtctccctccgccccccgctgcccccagagaacccgctatccatagcgaaggtcagtgggttacactccccgcccctctggatacaatcaacgttcacctgagagccgggtacatcatcccactccaaggacccgggctgactactacagaaagccggcagcaacccatggctcttgccgtggcgcttaccaaggggggcgaggctcgcggcgaactgttttgggatgatggcgaatccttagaggtactggagcggggcgcttatacacaggtcatctttctcgcccggaataacactattgtcaacgagttggttagggtcacaagcgagggggcaggcctccaacttcagaaggtgactgtcctaggagttgccacagctcctcagcaggtgctgtccaacggcgtgcctgtgtctaatttcacatatagccccgacacaaaagtactggacatttgcgtgagtctcctgatgggcgagcagttcctggtctcctggtgttag

SEQ ID NO: 2538 - DNA, 1611 bp, Artificial Sequence
  Description of Artificial Sequence: Synthetic coding sequence
atggagttcagctccccttctcgggaagagtgccccaagcccctgagcagggtcagtattatggcagggagccttaccgggctccttctgcttcaggccgttagttgggcctctggcgcgcggccttgcatccccaagagcttcgggtactcctccgtcgtttgtgtctgtaacgctacttactgtgattctttcgaccctccaacctttcccgcgctgggcacattctcccgctacgagagcacacgcagcgggcgccgcatggaattaagtatgggacccatccaagcgaaccacactgggactggcttgctgctcactttgcagcccgagcagaaatttcagaaggtgaagggctttgggggggctatgaccgacgctgccgctctgaacatcctggccctaagtccacccgcccagaatctgctccttaaatcttacttcagcgaggagggtatcggctataacatcatccgtgtacccatggccagctgcgactttagtatccgcacctacacctacgcagacacacctgacgactttcagcttcataactttagcctccctgaagaagatacaaagcttaagattccactcatccacagagccctgcagttggcccagcgtcccgtctcgctcctcgccagtccttggacttcccccacatggctgaagaccaacggtgcagtgaatgggaagggatctctgaagggacaaccgggggatatatatcaccaaacttgggccaggtatttcgtgaaattcctggatgcctatgccgagcacaaactgcaattctgggccgtgaccgccgaaaatgaacccagcgccggtctgctgtcaggctaccccttccagtgcctggggttcactcctgaacaccagagggattttatcgctcgcgacctgggtccgactctcgccaattccactcatcataatgttaggcttctcatgttggacgaccagcggcttttgttacctcactgggcaaaggttgtactcaccgatcctgaagccgcaaaatacgtgcatggaatagcagtgcattggtatttggacttcctggcaccagccaaggcgacactcggcgaaacacatcggctgttccccaacaccatgctcttcgcaagtgaggcctgcgtcggcagcaagttttgggagcaatccgtgcggctgggaagttgggacaggggaatgcagtactcacattccattattactaaccttttatatcacgtagtcggctggacagattggaaccttgcattgaatcccgaggggggtcctaactgggtaagaaactttgttgattcgccaattattgtggacatcacaaaggatacattttataaacaacctatgttttatcatctcggtcatttctcaaagtttattcctgagggcagtcagcgggttggactggttgcgagccaaaagaatgacttagatgcagtcgctctgatgcatccggatgggtccgctgttgtagtggtcctgaaccgcagctcgaaggacgtgccactcaccattaaagatccagccgtcggattcttggaaactatctcgcctggttatagcattcatacctatctgtggagaaggcagtag

SEQ ID NO: 2539 - DNA, 1611 bp, Artificial Sequence
  Description of Artificial Sequence: Synthetic coding sequence
atggagttcagcagcccaagccgggaggagtgccccaagccgctgagtcgggtatccattatggccggctccctgacggggctactactgcttcaggccgtcagctgggccagcggagcgcggccctgtatacctaaatctttcggttactcctctgtggtttgcgtctgcaacgctacatactgcgatagcttcgaccctcctacttttccggctctaggaactttcagtcgctacgagagtactaggtccggacggcgtatggaactgtccatgggcccaattcaggctaaccacactgggactggactgcttttgaccctgcagccagagcagaaatttcaaaaggttaaagggtttggcggggcgatgacggatgctgccgcccttaacattctcgcgcttagtccacccgctcaaaacctgctgctgaagtcctatttcagcgaggaaggaatcggttacaatattatcagggtgcccatggcatcttgtgactttagtataaggacatatacctatgcagatactcctgacgactttcaactccacaacttcagcttgcctgaggaggataccaaactgaagatccctctgatacaccgcgcattacagctcgctcagaggcccgtgtctctgctggcctccccatggacatccccaacatggctgaagacaaacggagcggtgaatggcaagggcagcctcaaagggcaaccgggtgatatctaccaccagacctgggccaggtattttgttaagttcctcgacgcctatgcagaacacaaattgcagttctgggccgttacagccgaaaacgagccaagcgcaggcctgctgagcgggtacccattccagtgcctcggattcactcccgaacaccagcgtgacttcattgctcgggatcttggtcccaccttggctaattctacccaccacaatgtgcggctcctcatgctcgacgaccagcgcctactcctaccgcactgggcaaaggtagtgttgaccgatcctgaggcagccaagtacgtccacggcattgcagtccactggtacctcgatttcctcgcaccagcaaaagcaaccctaggcgagacgcatcgactgttccctaataccatgctgttcgccagtgaagcttgcgtcggaagtaaattctgggaacaaagtgttcggctgggctcctgggataggggtatgcaatacagccatagtataatcacgaaccttctgtaccatgtggtgggatggactgactggaacttagcactcaacccggaaggaggtccaaactgggtgcgcaattttgtggattccccaattatcgtggatattacaaaagacaccttttacaagcaaccgatgttctaccacttgggccactttagcaagttcattccagaggggagccaacgcgtgggactggtcgcatcacagaaaaatgatctggacgctgtcgccctgatgcaccccgacgggagtgccgtcgttgttgttttaaatagaagctccaaagacgtgcctttgaccatcaaggacccggcagtgggtttcctggagaccatatcccctggttactccattcacacttacctgtggagacgtcagtag

SEQ ID NO: 2540 - DNA, 1566 bp, Artificial Sequence
  Description of Artificial Sequence: Synthetic coding sequence
atggagttctcctctccctcacgggaagagtgtccgaaaccgttgtccagagtaagcatcatggctggatctcttacgggcctgttgttgttacaggccgtgtcttgggccagcggagcaaggccttgtattcccaaatctttcgggtactctagtgtagtgtgtgtgtgcaacgctacgtattgcgactcttttgatcctccaaccttccctgccctcggtacattctccaggtacgagtcaacgcgctccggaaggcggatggaactgagcatgggccctatacaagccaatcataccggaactggccttctcttaactctgcaaccagacgccgctgcactgaatatattagcgctgtcgccgccggcacagaatcttctgctgaaatcttatttcagtgaggaaggcatcgggtataacattatacgcgtgcccatggcgagctgcgacttttctattagaacatacacctacgcagatacgcctgacgactttcagctgcataactttagtctccccgaagaagacactaagctaaagatccccttgatccaccgagccctgcaactggcccaacgtcctgtgtccctactggctagcccatggaccagtcctacatggctaaagaccaacggagctgtgaatggtaagggatccctaaaaggacagccaggagatatataccatcagacttgggcgagatacttcgtcaaatttctagatgcctatgctgagcacaagttgcagttctgggccgttacagcagagaatgaaccatccgcagggttgctatcaggttacccatttcagtgcctcggattcaccccggaacatcagcgagatttcatcgcgagggatctgggcccaacactcgcaaacagcactcatcacaacgttaggctgcttatgttggacgatcaacgcctgttactgcctcactgggctaaggtcgtgctcaccgaccctgaagcggccaagtacgttcacggcattgcggtacactggtacttggattttctcgcgcctgctaaagctacactgggcgagactcatcgcctgtttcccaacacaatgctgttcgccagtgaagcctgtgttggctcaaaattttgggagcagagcgtccgactggggagctgggatcggggaatgcagtacagccactcgatcataacaaatcttttataccatgtggtgggctggacagactggaacttggctcttaacccagaagggggacctaactgggtgcgtaactttgtggacagcccaatcattgttgatatcacaaaggatacgttctacaaacagcctatgttttaccacctggggcacttctcgaagtttatacctgaggggagtcagcgtgtgggcctcgtggccagccaaaagaacgatctggacgctgtcgccctgatgcaccctgacggctccgcggttgtggttgtccttaatagatcttcaaaggatgtcccactcactattaaagaccctgccgtcgggttcctggagactatctctccaggctattctattcacacatatctctggcgaaggcagtag

SEQ ID NO: 2541 - DNA, 1464 bp, Artificial Sequence
  Description of Artificial Sequence: Synthetic coding sequence
atggagttctcctccccttctagagaggaatgcccaaagcccctgtccagggtgagtatcatggccggatccctcacgggactgctgttattacaggccgtgtcatgggcgtccggtgcacggccatgcatcccaaagtctttcggttacagctccgttgtctgcgtctgtaacgccacttattgtgacagtttcgatccccctacattccccgccttgggtacattctcacggtacgagagcactcgttcaggacgcaggatggagctgtccatgggaccgatccaggccaaccacacaggaacgggcattggctacaacataatccgagtgccaatggcctcatgtgacttttctatccggacctacacgtacgctgatactcccgatgacttccagctgcataatttctcgcttcctgaggaggacacgaagttgaagattccacttatccacagggccttgcagttggcccagcgccccgtgtccctcctggcgtcgccttggactagccctacgtggctcaaaacaaacggcgccgtcaacgggaaggggtctctaaagggccaaccaggagatatttaccaccagacatgggcccgttacttcgtgaagttcttggacgcctatgctgaacataaactgcagttctgggccgttaccgcagagaacgagccttccgctggactcctgtctggataccccttccagtgtctaggcttcacgcccgagcaccagcgcgacttcatagccagggatctcgggccgaccctcgcaaacagtactcaccataatgtacgacttctcatgttagacgatcaacgcctcctccttccccactgggctaaagttgtcctgacagaccccgaggcagcaaagtatgtgcatggaatcgccgtacattggtacctcgattttctagcgcccgccaaagccacactcggggaaacccatcgcttattcccaaacacgatgctttttgcctccgaagcctgcgttggctccaagttctgggaacagtctgttagactgggatcatgggaccggggcatgcagtatagccattccatcataaccaatctactgtatcacgtcgttggatggaccgactggaacctggccctgaatcccgagggaggtccaaattgggtcagaaatttcgtagacagtcctatcattgttgacataacaaaggacacgttttataagcagcctatgttttaccacctcggacacttcagcaagttcattcctgaagggagccagcgcgtgggcctggtggcctcccagaaaaatgacctggatgccgtcgctctgatgcacccggacggtagcgcggtggttgtggttttgaatcgtagcagtaaggatgtacctctgaccatcaaggatcccgcagtgggttttctggagacgatcagtccaggttattccatacatacatacctatggcgccgccaatag

SEQ ID NO: 2542 - DNA, 1350 bp, Artificial Sequence
  Description of Artificial Sequence: Synthetic coding sequence
atggagctgtcaatggggccgattcaggccaatcacaccggaacagggcttctccttaccttgcaacccgagcagaagtttcagaaggtgaaaggctttggtggcgctatgacagatgctgcagccttgaacatcttagccttgagtccacccgcccagaacctcctgttgaaatcctacttttccgaggaaggcattggctataatattatacgtgtgccaatggccagctgcgatttctcgatcagaacgtacacctatgctgatactcccgatgattttcaacttcataacttttctctccccgaagaggacacaaagttgaaaattcccctcattcacagagccctccagctggcacagaggccagtcagtctcctagcctcaccctggacttcccctacttggctgaagacgaatggagccgttaacggtaaaggctccctcaagggacagccaggcgacatttatcaccagacatgggcaaggtatttcgtgaagttcctcgacgcttacgccgagcacaaactgcaattttgggccgtgactgcggagaacgaacctagtgctgggctgctgtccgggtacccttttcaatgcttaggctttacccctgagcatcagcgggactttatcgcgagagatctcggtcctaccttggccaatagtacgcaccataacgtgcgattgctgatgcttgatgaccaacgccttctgttgcctcattgggcaaaggtagtattgaccgatcccgaagcagctaaatacgtgcatgggattgccgtgcattggtacctcgattttcttgctcccgccaaggccactctgggagagacccacaggttgtttccgaatacaatgctgtttgcttctgaagcctgcgttggcagcaagttctgggaacagtcagtgcgtctcgggtcatgggaccgtggcatgcagtatagccactccatcattacaaacctgctgtatcatgtggtaggttggaccgattggaatttggctctgaatcccgaaggcggaccaaactgggtccgaaatttcgtggactcacccatcattgtggacattacgaaagatacgttttacaagcagcccatgttttatcacctgggacacttctccaagttcatccccgagggctcacagagggttggcctcgtagcaagccagaaaaacgatctggatgctgtggctctgatgcaccctgacggttctgcggtcgtggtcgtgttgaacagatcgtctaaggacgttcccctaactatcaaggaccccgcggtaggctttcttgagaccatcagtcccgggtactcgatccacacttacctgtggcgccgccagtag

SEQ ID NO: 2543 - DNA, 1482 bp, Artificial Sequence
  Description of Artificial Sequence: Synthetic coding sequence
atgacacttaggggatggtcattccaggtgttgcccgagtctaacgctacctattgcgatagctttgatccacccactttccctgctctcggaacctttagtagatacgagagcacacggtccgggcgacggatggagttgagtatggggcctatccaagccaaccacaccggaaccggcttgctgctcacccttcagccggagcagaagttccagaaggtcaaagggtttgggggagccatgaccgatgcagctgcactgaacatacttgcccttagtccgcccgcccaaaacttgcttttaaagagctacttttccgaggagggaattggctacaatattatcagagttccgatggcatcctgcgacttctctattagaacatacacatacgcagacacccctgacgattttcagctccacaacttttcacttccagaggaagatacaaagctcaaaattccactaatccaccgggctctacaactggcgcagcgaccggtttcacttctggctagcccctggacctctcccacttggctgaaaactaacggggccgtgaatggtaaaggcagccttaaggggcaacctggagacatctatcaccagacctgggcgcgctatttcgtgaaatttttggatgcatatgccgagcataagctacagttctgggccgtaaccgctgagaatgaacccagcgctggcctgctaagcggataccctttccaatgtcttgggtttactcccgaacaccagagggacttcattgctagggacctaggacctaccttggctaattcaacacatcacaacgtccggcttcttatgctggatgatcagaggctattattaccgcattgggcaaaggtggtcctgaccgatccagaggcagccaagtatgtgcacggcatcgcggtgcactggtaccttgattttttggccccagccaaggcaacattgggagagacccacagactgtttccaaataccatgttgtttgctagtgaagcttgcgtaggcagcaaattttgggagcaatcagtacgtttgggctcctgggatcgcggtatgcaatactcccactccatcatcaccaatctgctgtaccacgtagtgggatggacagattggaacctcgctttaaaccctgaaggcggaccaaactgggtgcgtaactttgtcgatagcccaatcatagtggatatcacaaaggacactttttacaaacagccaatgttttatcacttggggcattttagcaaatttatccctgaaggctctcagagggtcgggctcgtggcttctcagaaaaatgatctggacgccgtagccctaatgcatcccgatggttctgccgttgtggtagtactgaaccgcagcagcaaggacgtccctctgaccatcaaagatcccgccgtgggctttctcgagacgatttctccgggctattctatacacacctatctgtggcggcggcaatag

SEQ ID NO: 2544 - DNA, 1272 bp, Artificial Sequence
  Description of Artificial Sequence: Synthetic coding sequence
atggagttcagcagcccctcgcgcgaagagtgccccaagcccctgagtcgcgtgagtattatggccggctcccttaccggccttcttctgcttcaggctgtgagctgggcgagcggcattggatacaacattatccgggtgcctatggctagctgtgacttcagtattagaacatatacctacgccgataccccggacgactttcagctgcacaatttttctctacccgaagaggacactaaactgaagataccactgatccatagggctcttcagctggcgcagaggcccgtgtccctgttggcatcaccatggaccagtccaacctggctcaaaacaaacggggcagttaacggcaagggatcgctgaagggtcagccgggagatatttatcaccagacatgggcccgctacttcgtcaagtttctcgatgcttacgcagagcataagctgcaattctgggcggtcactgccgagaacgaacctagtgcagggctgctgtctggatacccttttcagtgtttaggcttcactcctgagcaccaaagagacttcatcgcccgcgacctggggcctactcttgccaactctacacaccacaatgtccgacttctcatgctggacgatcagcgactgctgctcccgcactgggcaaaagtcgtcctcacggaccccgaggccgctaaatatgtccacgggatcgcagttcactggtacctggatttcttggctccagccaaggcaaccctgggggaaactcataggctctttccaaacacaatgctgtttgccagcgaggcctgcgtcgggtcaaagttctgggaacagagtgtgcgccttggcagctgggatcgaggcatgcagtactcgcattcgataatcaccaacctgctgtatcatgtcgtcggttggacagactggaatctggccttgaatccggagggcggcccaaattgggtgaggaactttgtggacagtcccattattgttgatattaccaaggatacattttacaagcagccgatgttttaccatttggggcactttagcaagttcatcccagaggggtcccagcgggtgggcttggtcgccagccagaagaacgatctcgatgccgttgcactgatgcaccctgatggatcagcggttgtggtggtcttgaatagatccagcaaagatgttcctcttacaataaaggacccggcggtgggcttcttggagactattagtcctggctattccattcacacatacctttggcggcgccagtag

SEQ ID NO: 2545 - DNA, 2112 bp, Artificial Sequence
  Description of Artificial Sequence: Synthetic coding sequence
atgttacggggaaggtccctttcagtgacctcactaggcggcctgccacagtgggaggtggaagagctgcctgtggaggagttgctgctctttgaggtggcttgggaagtgacgaataaagtgggagggatctataccgttatccaaactaaggccaagacaaccgccgatgaatggggggagaactacttcttaattggaccctatttcgaacacaacatgaagacgcaagtggaacagtgtgaaccagtcaacgatgcagtgaggcgggctgtagacgccatgaacaaacatgggtgccaggtgcactttggacgatggttgatagaaggatctccttatgtcgtgttgtttgatattgggtacagcgcttggaatctggatcgctggaaaggcgatctctgggaggcctgttccgtgggcatcccctaccatgaccgggaggccaacgatatgctcatattcggcagcctgaccgcctggttcctcaaggaggtgaccgaccatgcagacggcaaatacgtggtagcacagttccatgagtggcaggccggaattggcctcatcttatctagagcccgcaagctgcctatcgcgaccatatttacaactcacgcaactcttcttgggagatacctgtgcgctgcgaacatcgacttttacaatcatctcgacaagttcaatatcgacaaggaagctggtgagagacagatttaccaccggtactgcatggagagagcctctgtccactgcgcacacgtatttacaacagtgagcgagattactgcgatcgaggctgagcacatgctaaaaaggaagccagatgtagtgacaccaaacggcctgaatgtaaagaagttctctgccgtgcacgagttccagaacctgcacgctatgtataaggctaggatacaggacttcgtccggggtcacttttacggtcatcttgactttgatcttgaaaagactctcttcctcttcatcgccggtcgctacgaattctccaataaaggcgcagacatctttcttgaatccctgagccgactgaatttcctgctccgtatgcataaatctgacattacagtcatggtgtttttcatcatgcccgccaagactaacaactttaatgtggagactctcaagggacaggcagtgcgaaagcaactctgggatgtagcccattccgttaaggaaaagttcgggaagaaattatacgacgctctgctccgaggcgagatccctgacctaaacgatatccttgacagggatgatttaaccatcatgaaaagggccatcttcagtacacagcgccaatctctaccaccggtcaccacacataacatgatagacgattccactgatcctatattgtccactattaggcggattggtctgttcaataatcggactgacagagtgaaagttattcttcaccccgagttcctaagtagcacaagccctctgcttcccatggactacgaagaattcgtgagaggatgtcacctgggagtgttcccttcttactatgaaccatggggctacacccccgctgagtgtacggtcatgggaatcccttcagtcacaacaaacttgtccgggtttggttgctttatgcaggaacatgtagcagaccctactgcctatggcatctacattgtagatagaaggttccgtagccccgatgattcctgtaatcagcttactaagtttttgtacgggttttgcaaacaatcccgcagacaacgtattatacaacgcaaccggacggaacgtctgtctgatctgctcgactggagatatctgggccgatactaccaacacgcccggcacctgactctgtccagggcctttcctgacaagtttcacgtggagctaactagccccccaacaactgaaggctttaagtaccctcgccctagctccgtccctccatctccttcagggtcacaggccagctcaccacagtcctcagatgtcgaggatgaggtggaggacgagcgctatgacgaagaggaggaggcagaacgggatcggttgaacattaaaagtcccttctcactctcacatgtgccacatggcaagaagaaactgcacggcgagtacaaaaactag

SEQ ID NO: 2546 - DNA, 351 bp, Artificial Sequence
  Description of Artificial Sequence: Synthetic coding sequence
atggattactatagaaaatacgctgccatcttcctggtgacgctcagcgtgttcctccacgtgttacattctgcacccgatgtgcaggactgtcctgagtgcactctgcaggagaacccgttcttttcacagcccggcgctccaatcctccagtgcatgggctgctgtttttcccgggcttaccccacccccctgagatctaaaaaaactatgcttgtgcaaaagaacgtgacatctgaatctacctgttgcgtggctaagtcatacaacagggtcacagtcatgggtgggttcaaagtggagaaccacaccgcatgtcactgtagcacatgttattatcataagtcatag

SEQ ID NO: 2547 - DNA, 654 bp, Artificial Sequence
  Description of Artificial Sequence: Synthetic coding sequence
atggcaacagggagcaggacttctctgctgctcgcctttgggctactttgcctcccatggttacaggaggggagtgcatttccaacaattccactctccaggcttttcgacaatgctatgctcagggcgcaccggctccaccaattagccttcgatacgtaccaggagttcgaagaggcctacattcccaaagagcaaaagtactctttcctacagaacccacaaacctccctttgctttagcgaatcaatccctacaccatctaatcgcgaggagacacagcagaagtccaatctagaactccttcggattagccttctgctcatccagtcttggcttgagccggttcagttcttgagatccgtctttgcaaattcgctcgtgtacggagcaagcgattccaacgtttacgacctgctgaaggacttagaggaagggatccagacccttatgggaaggctagaagacggctcccctcggacaggtcagatcttcaaacagacttatagtaagtttgatacgaactcccacaatgacgacgctctactcaagaattacggattgctttattgtttccgcaaagatatggacaaggtggagacctttctcagaattgttcagtgcaggagcgtggagggctcttgtgggttctag

SEQ ID NO: 2548 - DNA, 369 bp, Artificial Sequence
  Description of Artificial Sequence: Synthetic coding sequence
atggctactgggagccgcacttccttgcttttagcattcggccttttatgccttccttggttgcaagaggggagcgcatttcccacgataccgctgtcccgattgttcgataacgcaatgctgcgagcccatcggctgcatcagttggcttttgatacctatcaggaatttcggttagaagacggttccccccggaccggtcagatcttcaagcagacatattccaaattcgacacaaattcccacaacgacgacgcgctgctaaagaactacggtctcctgtactgcttcagaaaagacatggacaaagttgagacattcctccgcatcgtccaatgccggagcgtggaagggtcatgcgggttctag

SEQ ID NO: 2549 - DNA, 534 bp, Artificial Sequence
  Description of Artificial Sequence: Synthetic coding sequence
atggcaacagggtctcgaacctcactccttctagctttcggtctactgtgcctgccttggttgcaggaaggcagtgcctttcccactatccccctgagtcgtcttttcgataacgcgatgctgagggcccatagattacatcaactggctttcgacacgtaccaggaattcaacttagagttgttgcggattagcctcttgctgatccagagttggttagaacctgttcagtttcttcgatcagtcttcgcgaatagcctggtatacggggcaagtgattcaaacgtgtatgatctgctcaaagaccttgaggaagggatccagacattgatgggtcggctggaggatggtagtcctaggaccgggcagatctttaagcaaacttacagcaaatttgatacaaattcacataacgacgatgccctcctgaagaattacggactcctctattgtttcaggaaagacatggacaaagtcgagaccttcctgagaattgtccagtgcaggtcagttgaaggaagctgtgggttttag

SEQ ID NO: 2550 - DNA, 609 bp, Artificial Sequence
  Description of Artificial Sequence: Synthetic coding sequence
atggcaacagggagtcgcacctctctgctgctggcctttggactgctttgcttaccctggctccaggagggttccgccttccccactattcctctgtctagattattcgataacgctatgctccgcgcccatagactgcatcagctggcttttgatacttaccaggagttcaacccacagaccagcctgtgttttagcgagagtattcctaccccaagtaacagggaggaaacacagcagaaatccaacttagaactgctgagaatttcccttctccttattcaatcttggctggaaccagtccagttcttgagaagtgttttcgctaactccctggtgtacggggccagcgatagcaatgtctacgatctactgaaagatctggaagagggtatacaaaccttaatgggtcgcctggaagacggatccccgcgcactggtcagattttcaaacagacatattctaagtttgacaccaacagtcataacgacgacgccctgctgaaaaattacgggctgctgtattgttttagaaaagacatggataaagtggaaacgttccttcgcatcgttcaatgtcgcagcgtagagggctcatgcggattttag

SEQ ID NO: 2551 - DNA, 771 bp, Artificial Sequence
  Description of Artificial Sequence: Synthetic coding sequence
atggctgccggctcaaggacatccttactgctcgcctttgggctgctgtgcctctcttggctccaggaaggctctgcttttccaacaatccccctttctagactgtttgataacgcaatgctgagagcacgccgcctctatcaactcgcctacgacacgtatcaggaattcgaggaagcgtacatcctgaaggagcagaaatacagttttctccaaaatccccagacctctctgtgtttttcggaatctataccgaccccctcaaaccgggtgaagacccagcagaagtcaaatctggagctcctgcgcatctctctattgctaatccagtcgtggctcgaacctgtacagctcctgcgatcggtgttcgccaattctctcgtgtacggcgcctcggactcaaatgtgtatcgtcacctgaaggatctggaagaaggcatacagacattgatgtgggtacgcgttgcccctggcatcccaaatcccggagcccccctggcatctagagactggggagagaaacattgttgtccactgttctcctcccaggcgttaacacaagagaattccccctattcttctttccccttggtgaatccaccaggattatctctgcaaccagggggcgaaggtggaaagtggatgaacgagcgcggacgcgaacaatgcccgtccgcttggcctttacttctgtttctgcacttcgcggaagctggccgttggcagccacccgactgggctgatcttcagtccgtgcttcagcaggtgtag

SEQ ID NO: 2552 - DNA, 654 bp, Artificial Sequence
  Description of Artificial Sequence: Synthetic coding sequence
atggcagcaggatctaggacgagcctgctgcttgcctttggcctgttgtgcctaagttggctgcaagaggggtccgctttccctaccatccctctttcccgtctctttgataacgccatgttaagggctcggcgcctgtatcagctggcctacgatacttaccaagagtttgaggaggcatacatcctgaaagaacagaagtatagctttctgcaaaatcctcaaacctcactctgtttttccgaatctatacctaccccatcaaacagagttaaaacccagcagaagtccaacttggaactcctaaggatttcacttctactgatacaatcttggttagaaccagtacaacttctgcggtctgtgtttgccaattcgttggtctacggcgcaagtgattccaacgtatacagacatctcaaagatctggaggagggcatacagaccttgatgtggcgccttgaggacggaagccctaggaccggacagatattcaatcaatcttatagtaagttcgatacaaaatcccacaacgatgacgctctccttaaaaattatggccttctctattgttttaggaaagatatggacaaggtggagacctttttacgcatagttcagtgtaggagtgttgaaggaagctgcggattttag

SEQ ID NO: 2553 - DNA, 609 bp, Artificial Sequence
  Description of Artificial Sequence: Synthetic coding sequence
atggcagctggatctaggacttccctgttactagcattcggattgctgtgcctgtcttggctgcaggaagggtctgcctttcccacaatccccttatctagattattcgataacgcaatgttaagggcccgtcgcttataccagctggcatacgacacatatcaggaattcaacccccagacttctctctgtttttctgaatcaattccgacgccgagcaacagagtgaaaacacaacagaaatctaaccttgaactcctgaggatatctcttctcctgattcaatcctggttggaacccgtgcaattgctgaggtctgtatttgctaactcgctcgtgtacggagcctccgattccaatgtctatcgtcacctgaaagatcttgaagagggtattcagaccctaatgtggcgacttgaagacggaagtcctcgcacgggacagatttttaaccagagctattcaaagttcgacaccaagtctcacaatgacgacgcattgctcaagaactacggccttctgtattgcttcaggaaggacatggacaaagtggagacttttcttcgcatcgttcagtgtcggtctgtcgagggttcttgcgggttctag

SEQ ID NO: 2554 - DNA, 738 bp, Artificial Sequence
  Description of Artificial Sequence: Synthetic coding sequence
atggccgccggctctcgaacatcacttctgctggcatttgggcttctgtgcctttcttggctacaagaaggaagtgccttccccaccattcccctttccagactgttcgataacgcgatgcttcgggcaaggagattataccagctggcctacgacacatatcaggagtttgaggaggcatacatcctgaaagaacaaaaatacagttttcttcagaatccgcaaacatccctttgcttctcagagtcaattcccactccctctaaccgcgtgaaaacccagcagaaatcaaatttagagctgctgaggatcagtctgctacttattcagagctggttggaacccgtgcaattgttaagatccgtcttcgccaacagtcttgtgtatggtgcgtctgacagcaacgtctaccgtcacctgaaagatctggaagagggcatccagacactgattggctggaagatggcagcccctgggctcggtcggtcctcgattagtcccactgcatccctgacccagaatagaaccaccatgactcattgctccaggaccaccggatgctcaaccgcttccggcaggacatggactcggtctcggcactcgtgtgcttcttgttcagccgcactatggagggctgccgtcgcttcctcttgtccaggtggcataccagtgaccccaccccagtgtctatcctggtcctggaaggtcctcctccaatgtccaccagcactgagctag

SEQ ID NO: 2555 - DNA, 753 bp, Artificial Sequence
  Description of Artificial Sequence: Synthetic coding sequence
atggaaaagggcccagttcgcgccccagctgaaaagccccgcggcgcacggtgttccaatgggtttcctgaaagggatccccctaggcctgggcccagccggcctgccgagaagccaccccgcccggaggccaagtccgctcagccagccgatggttggaagggagagcggccccgttccgaagaagacaacgagcttaacctccctaatctagcagcagcctatagctccattcttagctcacttggtgaaaacccgcagcgccaagggctcctgaaaactccctggagagccgcctcagccatgcaatttttcacaaaaggttaccaggagactatctcagacgtactgaacgacgcaatcttcgacgaagatcacgacgagatggttattgtaaaggatatagacatgttcagcatgtgcgagcaccaccttgtccctttcgtcggtaaggttcacatcgggtatctgccaaacaaacaggtgctgggactgtctaaattagcccgaatcgtcgaaatctacagccggcgactacaggtccaagagcgactaaccaagcaaattgccgtggccataacagaggccctccgaccagcaggagttggagtggttgtcgaagccacccatatgtgcatggtcatgagaggtgtccagaaaatgaatagcaagaccgtcaccagtaccatgctcggagttttccgagaggatcctaaaacccgagaagaattcctaaccctaatccggtcctag

SEQ ID NO: 2556 - DNA, 693 bp, Artificial Sequence
  Description of Artificial Sequence: Synthetic coding sequence
atggagaagggccccgtccgggcccctgctgaaaaaccacggggcgctcgctgctccaacggcttccctgagagagaccccccacgccccggcccttctaggccagccgagaaacccccaaggcccgaagctaagtccgcacagccggccgacggttggaagggtgagcgccctagatcagaggaggataatgagttgaatttgcccaatctcgcagccgcctactcatctattctgtcatccctgggtgagaatccccagcgacagggcttgctcaagactccctggcgagccgcgtccgctatgcagtttttcacgaaaggttaccaggagaccatcagtgatgttttgaatgacgccattttcgatgaggatcacgacgagatggttatcgtcaaagacatcgacatgtttagcatgtgcgagcaccacctggttccattcgtaggcaaggtccacataggatacctgcctaataagcaggtgctgggtctgtcaaaattggccagaatagtagaaatctactctaggaggctgcaggtccaagaaagactcaccaaacagatcgcggtggctattacagaggcgctgcgtccagccggcgtgggtgtggtggtggaggctactaaatccaataaatataacaagggattatcctatttcctgttggccacattcctatggcagtattag

SEQ ID NO: 2557 - DNA, 753 bp, Artificial Sequence
  Description of Artificial Sequence: Synthetic coding sequence
atggagaaaggcccggtccgcgccccagccgagaagccccgtggcgcgaggtgtagcaacggtttcccagaacgcgacccaccgagaccagggcccagtagacctgcagagaagccccctcggccagaggcaaagtctgcgcagccagccgacggttggaaaggagagcgccctaggagtgaggaagataatgaacttaacttgcccaacctggcagccgcatacagcagcatactgtcgtcacttggcgagaatccacagagacaggggctgctgaagaccccgtggagagccgccagcgctatgcaattctttaccaagggctatcaagaaacaataagcgacgtgctgaatgacgcaattttcgatgaggaccacgacgagatggtgatcgtcaaagacattgatatgttcagcatgtgtgagcaccatttggtgccgttcgtgggaaaagtgcacataggctaccttcccaataagcaggtgcttggcctgtcaaagctggcccgtattgtcgaaatctattcaagaaggcttcaggtacaagagcgacttaccaaacagatcgctgtggcaatcactgaggccttgcgcccggcgggagtaggggttgtggtggaggccactcacatgtgtatggttatgaggggagtccagaagatgaacagtaagaccgtgaccagcacaatgctgggcgtgtttcgagaggacccaaaaacaagggaagagttccttactctgatacggtcatag

SEQ ID NO: 2558 - DNA, 642 bp, Artificial Sequence
  Description of Artificial Sequence: Synthetic coding sequence
atggaaaaagggcctgtcagagcaccggcagaaaaaccacggggagctcgctgctctaacgggtttcctgagagggatcccccccgacccgggccgtctcgtcccgctgagaagcctccccggccggaggccaagtctgctcagcctgctgatgggtggaaaggggaacggccgcggtcagaggaggacaatgaactgaatttgccaaatctggccgccgcttacagctctatactgtcaagcctgggtgagaacccacagcggcagggattgcttaagactccctggagagctgctagtgccatgcagttttttacaaaaggatatcaggagaccatttcggatgtgctgaacgacgccatattcgatgaagaccatgatgagatggtgatcgtaaaggatatagacatgttctccatgtgtgagcaccacctggtccctttcgtcggcaaggtacacatcgggtatctccccaacaagcaggtgcttggcttgagcaagctggctcgtattgtggagatatattcccggcgactccaggtgcaagagagactgaccaagcagatcgctgtcgcaatcacagaggctttacgcccagctggtgtcggcgttgtcgtcgaagcaacgtctgcggagccttag

SEQ ID NO: 2559 - DNA, 702 bp, Artificial Sequence
  Description of Artificial Sequence: Synthetic coding sequence
atggagaaaggccctgtgagggcaccagcggaaaagccaagaggagctcggtgctctaatggctttccagagagagaccccccgagaccaggcccatcgagaccagctgagaagcctcctcggccagaggcgaaatcagcccagcctgctgatggctggaagggagagcgaccgcgctccgaggaggataacgaactcaatctgccaaatctggctgcggcttactccagcattttgtcatcacttggtgaaaatcctcaacgacaggggcttctgaagactccatggagggccgccagtgcgatgcaattctttactaaagggtaccaggagacaattagtgacgttctgaatgacgccatctttgacgaggatcatgacgagatggtgatcgtgaaagatatagatatgttcagtatgtgcgaacaccacttggtgccttttgtcggcaaggtgcacattggatatctacctaacaaacaggttcttggactgtctaaactggcacgcatagtggaaatctactcaaggcgcctgcaagtacaagagcggctgaccaagcagatcgccgtagcaatcactgaggcgttgagaccggccggcgtgggagttgttgtggaagccactaaatctaacaagtataacaaaggactgagccccctgttgtcatcttgccatctgtttgtcgcgatcttaaaatag

SEQ ID NO: 2560 - DNA, 1014 bp, Artificial Sequence
  Description of Artificial Sequence: Synthetic coding sequence
atgggcccccgcgcccgtcccgctctgctgctcctaatgctcctgcagaccgcggtgctccagggtcggctccttcgtagtcactcactgcactacctattcatgggcgcttctgaacaggaccttggtctaagtttgtttgaagccctgggatacgtggatgatcagttgtttgtcttttacgaccacgaatcgagacgtgttgagccaaggactccatgggtctcttctcgaataagcagtcagatgtggctgcagcttagccagtcacttaaaggatgggaccacatgttcactgtggacttctggactatcatggagaatcacaatcacagtaaagagtctcacactctgcaggtgatcctggggtgtgagatgcaggaagataactctaccgagggctactggaagtatgggtacgatgggcaagaccacttagagttttgtccagacacgcttgattggagggctgcggaaccacgagcttggccaaccaaactcgaatgggagaggcacaaaatacgggctcgacagaatcgcgcctacttggagagagactgtcctgctcagcttcagcagctgctcgaactcggaagaggcgttttggatcagcaggtgcctcccctggtgaaagtgacccaccacgtgactagctccgtaactaccctgagatgtagagcacttaactactatccccagaacatcacaatgaagtggctaaaggataagcagccgatggacgccaaggagtttgaacccaaagacgtgctccctaatggcgacggaacctatcagggatggatcacactggctgtgccaccaggggaggaacagcggtatacctgtcaggtggaacatccgggcctcgatcagccgctgatcgtgatatgggagcctagcccaagcggaacgctggtgattggagtcatctcaggtatcgctgtgttcgtggtcatcctatttatcgggatattgtttatcattttgagaaaaagacagggttcctcgttctag

SEQ ID NO: 2561 - DNA, 771 bp, Artificial Sequence
  Description of Artificial Sequence: Synthetic coding sequence
atgggcccacgggccaggcccgcacttctcctcctcatgctccttcagacagcagttttacagggtcgtcttctgcgctcccacagcctgcattacctattcatgggcgcaagtgagcaggacttgggactgagcttatttgaggctctcggatacgtggatgaccagctgttcgtgttttacgatcacgagtccagacgggttgagcctagaaccccgtgggtcagtagtcgcatttcctctcagatgtggcttcagctaagtcagagtcttaaaggctgggatcacatgttcaccgtcgacttctggactatcatggaaaaccacaatcacagcaaagtgccgcctttagtcaaggtgacccatcatgtcacctcgtctgtgaccactctccggtgccgcgcgctgaattattatccacagaacattactatgaagtggcttaaagataaacagccgatggacgctaaggaattcgaacctaaagatgttctgccaaatggcgacggaacgtaccaggggtggattactcttgcagtgccccccggtgaagaacaaagatacacatgtcaggtggagcacccaggactggaccagcccctcatcgtgatatgggagccatcaccttcaggcaccctcgttattggagtcatttctggaatagcggtattcgtcgtcattctattcatcggaatcctgtttatcattctgcgtaagcggcaagggtcgaggggcgccatgggccactacgtcctggctgagagggaatag

SEQ ID NO: 2562 - DNA, 729 bp, Artificial Sequence
  Description of Artificial Sequence: Synthetic coding sequence
atgggcccccgggccaggcccgccctgctgctactaatgcttttgcaaacggcggtactgcagggaagactgctgcgctcgcactcactccactacttgttcatgggagcctccgaacaagacctcggcctttcgttatttgaggctctcggctacgttgacgatcaactgtttgtcttttacgatcacgagtcaagacgagtggagcctaggacaccttgggtgtcgtcccgtatctcctcccagatgtggttgcagctgtcacagtccttgaagggctgggatcatatgtttacagtcgatttctggactatcatggaaaaccacaaccacagtaaggtgactacattgcggtgcagggccctaaattactacccccagaacattaccatgaaatggctaaaggacaaacagcctatggatgctaaggagttcgagcctaaagatgttctgcccaacggcgatggtacatatcaaggttggataaccctggccgttccccccggcgaggagcaacggtatacttgccaagtggagcatccgggactggatcagcccttaattgtgatttgggagccttccccgtccgggacgctcgtgattggggtgatatctggtattgctgtatttgtcgtgatccttttcattgggatactttttatcattctgaggaaaaggcaggggtcccgtggtgctatgggccactatgtcctggcagagagagaatag

SEQ ID NO: 2563 - DNA, 783 bp, Artificial Sequence
  Description of Artificial Sequence: Synthetic coding sequence
atggggccccgcgctcgccctgctcttctgctcctcatgctgctgcagaccgcggtgctgcagggaagactcctgcagagccacaccttacaggtgatacttggctgtgagatgcaggaggataacagtacagaaggatattggaagtacggatatgacggtcaggaccacttggagttctgccccgacacactggactggcgggcggccgaaccccgagcttggccgaccaaactagaatgggagcgccataagatccgagccagacagaacagagcctatctggaacgagactgtccggcacaacttcagcagcttcttgagttgggcaggggcgtactggatcaacaagtgccacctctggtgaaggtgacccaccacgtcacatcaagtgtgacgaccttgcgatgcagagccttaaattactatccacagaatatcaccatgaagtggctcaaggataaacagcctatggatgccaaggagtttgagcctaaggatgtcttgccaaatggcgacggaacataccagggatggatcaccttggctgtgcccccaggcgaagagcaaagatacacctgccaggtggaacaccccgggctggaccaacctttaatcgtgatctgggaaccgtcaccctccggcacccttgtgattggtgtgatctccggaatcgctgtgtttgtcgtcatcctttttatcggaattctgtttatcatcctgcgaaagcgtcagggaagcagaggcgcaatgggccactacgttctcgctgaaagggaatag

SEQ ID NO: 2564 - DNA, 231 bp, Artificial Sequence
  Description of Artificial Sequence: Synthetic coding sequence
atgggcccaagagcccggccagccctgctgcttcttatgttattgcaaaccgccgtgctccagggaaggctgctccagccctcaccttccggcactctggtgatcggggtgatttccggtattgccgtgttcgtggtaatactgttcataggtattctgttcattatactccgcaaacggcaagggtcgcggggagctatgggccattacgtgttagccgaacgagaatag

SEQ ID NO: 2565 - DNA, 507 bp, Artificial Sequence
  Description of Artificial Sequence: Synthetic coding sequence
atgggtcctagggctagacctgccctcctgctgctaatgctgctccaaacggccgttctacaaggtcgactcctgctcccaccccttgtgaaggtgacccatcacgttaccagttccgttacaactctgagatgtcgcgccttgaattactacccacagaatattaccatgaagtggcttaaggacaagcaacctatggatgctaaggaatttgagccaaaagacgtcctgcccaacggagacggtacatatcagggctggattacacttgcagtgccccccggcgaagagcagcggtacacctgtcaggtggagcatcctgggctcgatcaaccactcatcgtgatctgggaacctagcccctcaggcactcttgtcattggagttataagcgggattgcagtgttcgttgtgatcctatttatcggaatactctttattatactacggaaaaggcaaggtagcagaggagccatgggacactacgtgctggcggagagagaatag

SEQ ID NO: 2566 - DNA, 1047 bp, Artificial Sequence
  Description of Artificial Sequence: Synthetic coding sequence
atgggccctcgcgctaggccggccctgctgctgttaatgctgctgcaaacggcagtcctgcagggtcgacttcttcgatctcactctctgcactacttattcatgggtgcatctgaacaagacttaggattgtccttgttcgaggccctggggtatgtggacgaccagttgtttgtgttttatgaccacgagtcgcgcagggttgagcccagaaccccctgggtgtcttctagaatctcctcccaaatgtggcttcaactgagtcagagcctgaaagggtgggaccacatgttcaccgttgacttctggactataatggagaaccacaaccacagtaaggagtcccatactttgcaggtgatccttggttgcgagatgcaggaagacaactccaccgaaggatactggaaatacggctatgatggccaggatcacctggagttctgccccgacacgctggactggcgggcagccgagcctcgggcatggccaacgaaattagagtgggagcgccataaaatcagagccaggcagaatcgtgcctacctggagcgtgactgcccagcgcaacttcaacagttgctggaattgggaagaggggtgctggatcagcaggtccctcctttggtcaaagtgacccatcatgttacgtccagcgtaacaactctacgctgcagagctctcaactattacccacagaatatcaccatgaagtggcttaaagacaagcagcctatggatgccaaagaattcgaacctaaagacgtgcttcccaatggcgatggaacttaccaggggtggatcacactggctgtccctccaggtgaagagcagcggtacacatgccaagtagagcacccgggactcgatcagcccttaatcgtaatttgggaaccctccccctccggaactctggtgattggggtgatcagcggcatcgcggtatttgtggtgatattgtttataggcatcctgtttataattctacgcaaacgccagggcagcagaggcgccatgggtcactacgtgctcgctgaacgtgaatag

SEQ ID NO: 2567 - DNA, 978 bp, Artificial Sequence
  Description of Artificial Sequence: Synthetic coding sequence
atgggcccaagagctcgcccagccctcctgctgcttatgttactacagaccgcggtgctgcaaggtagactactgcctcttggctacgtagacgaccagctcttcgtgttttatgatcacgagagtcgaagggtagaacctcgtaccccatgggtttcgagccgaatcagctcccagatgtggttgcagctgagtcagagtttgaaaggctgggaccacatgtttaccgtcgatttctggactatcatggaaaatcataatcacagtaaggaaagccataccctgcaggtcattcttggttgcgagatgcaggaagataacagcactgagggatattggaaatacggctacgatgggcaggaccaccttgaattctgtcccgacactctagactggcgagcagccgagccacgggcctggcctaccaagttagaatgggagcggcataaaataagggctcgccagaatagagcatatttggaacgggattgcccggcacagttgcaacagctcttagaactgggtcggggagtgctggaccaacaggttccccccttagtcaaggttactcaccacgtgaccagcagtgtgactacgcttcgctgcagggcccttaactattacccgcagaacattactatgaaatggctgaaggataagcagccgatggatgccaaggagtttgaacccaaagatgtcctacctaatggagatggcacataccaggggtggattactttagcagtgcccccaggcgaggaacagaggtatacttgccaggtcgaacacccaggccttgaccagcccctgatagtgatttgggagccttcgcccagtggtactctggtcataggagtgattagtgggatcgctgtttttgttgtgattctgttcattggcatattgtttatcatcctcaggaagcgccagggcagtcgaggagctatgggccattatgttctggctgagagagagtag

SEQ ID NO: 2568 - DNA, 1005 bp, Artificial Sequence
  Description of Artificial Sequence: Synthetic coding sequence
atgggacccagagctagacccgccctgttgctgcttatgctactgcagactgccgtgctgcaggggaggcttctaagaagccacagcctgcactacctcttcatgggggccagcgaacaagacttaggactatccttgttcgaggctctgggctacgtcgacgaccaattgttcgtattctacgaccacgaatccagaagggtggagccgaggaccccatgggttagctccaggatttccagccagatgtggttgcaactttcccagtcactcaaaggctgggaccacatgttcactgttgacttttggactattatggagaatcataatcactccaaagagagccatactctccaagtgatcttggggtgcgagatgcaggaggataacagcacagagggttactggaagtacgggtacgacggacaggatcacctcgaattctgcccagacactctagactggagggcagcagaacctcgggcttggccgaccaagctcgaatgggagaggcacaaaatccgggccaggcagaatcgcgcatatctggagcgtgattgccccgcacagctgcagcagttactggagctcggacgcggcgtgttagaccagcaggtcactacattacggtgccgggctctaaattattaccctcaaaacatcacaatgaagtggctgaaagataagcaacctatggacgctaaagaatttgaacctaaggatgtattgccaaacggggacggtacttaccaggggtggatcaccttggccgtcccccctggcgaggagcagagatatacctgtcaggttgagcaccccggtcttgaccagcctctgattgtcatatgggaaccctctccatcggggaccctagtgattggagtcatctccggcatcgccgtatttgttgtcattctgtttatcgggattttgtttatcatccttcgtaagcggcagggttctcggggcgccatgggccactacgtactggccgaacgtgaatag

SEQ ID NO: 2569 - DNA, 1038 bp, Artificial Sequence
  Description of Artificial Sequence: Synthetic coding sequence
atgggccctagggcacgacccgctctcttgctgttgatgctgctgcagaccgccgttctgcagggccgcctcctccggtcgcatagtttgcactatctttttatgggggcctctgaacaggacctggggctgtcactgttcgaggcactcgggtatgtggacgatcagcttttcgtgttttatgaccacgagtcccgaagggtggagcctcgcacaccttgggtgtcctcgcggatctcctctcagatgtggctccagctgtcacagagcctgaagggctgggatcacatgttcactgtagatttttggacaattatggaaaaccataaccattcgaaggagagccatacattgcaggttatcctgggatgcgaaatgcaggaggacaactccacagaagggtattggaaatacggatacgacggacaggaccacctggagttttgcccagatacgctagattggcgcgctgccgagcctagagcatggccaacaaaactggaatgggaaaggcacaagattcgggcccgtcaaaatagagcttaccttgagcgcgactgtcccgcccagctccagcagctcctggagctgggccgtggtgtgttagatcaacaagaaggcagcgagtcttcctctctgcctggcaaggtgactactctccggtgcagggccctgaactactaccctcagaatataacaatgaaatggcttaaagacaaacagcctatggatgcaaaggaatttgaaccaaaggacgtactccccaatggtgacggcacctaccagggctggatcacacttgccgtcccacccggcgaagaacagagatacacttgccaggtcgagcatcccggtctggaccagccattgattgtgatttgggaaccctctcccagtggtacgttggtgattggtgtgatttcaggtatcgctgtttttgtagtcattttgttcatcggcattctcttcataatcctgcgcaagagacaggggagtcgcggagcaatgggccattatgtactggccgagcgcgaatag

SEQ ID NO: 2570 - DNA, 741 bp, Artificial Sequence
  Description of Artificial Sequence: Synthetic coding sequence
atgggccctcgcgctcggccagccctgttgctgctgatgctcctccagacggctgtgctgcaggggcggctgctgcagagtcacacgttacaggtcatcctgggatgtgaaatgcaggaggataactctacagaaggctattggaaatacggttatgatgggcaggatcatctcgaattctgcccagatacccttgactggcgagcagccgaaccccgggcctggcccacgaagcttgaatgggaaaggcacaaaatccgggcaaggcagaatagggcttaccttgaaagggactgccctgcacaattacagcagttgctggagctggggaggggagtgctggatcagcaggtcacgacactgcgctgtcgggcgcttaattactatccacagaatatcactatgaaatggctgaaggacaagcaacctatggacgctaaggaatttgaacccaaagatgtgctacctaacggtgatggcacataccaagggtggattaccctcgctgtccccccgggcgaagaacagcgctatacttgtcaggtagaacatccaggcttggatcaacccctgatcgtgatctgggaacctagtccctcgggtacactcgttataggggtaatctctggaatcgccgtctttgtcgtgatccttttcatagggattctgttcattatcttacggaaaagacaagggtctcgcggcgcaatgggacattacgtgctggcggaacgagagtag

SEQ ID NO: 2571 - DNA, 486 bp, Artificial Sequence
  Description of Artificial Sequence: Synthetic coding sequence
atggggccacgtgcccgaccggcccttctcctgttgatgttattacaaactgctgtgttacaggggagactgctgcgctcacactccctgcactacctcttcatgggtgcttcagaacaggatttggggctgtctctgttcgaggcactggggtacgttgatgaccagctgttcgttttttatgaccacgagtctcgacgggtcgaaccccgtaccccctgggtgagctcaaggatttcttcccagatgtggttgcagttgagtcaaagtctaaaaggctgggaccacatgtttactgttgacttctggacaattatggaaaatcataaccacagtaaggagtctcatactctccaggtgatattggggtgtgaaatgcaggaagacaacagcaccgagggttactggaagtatgggtacgatgggcaggtgctgcaggacaccatttacagttccgaggtgtcctcgctgggcattaaattctag

SEQ ID NO: 2572 - DNA, 366 bp, Artificial Sequence
  Description of Artificial Sequence: Synthetic coding sequence
atggagaaccacaatcactcgaaggagtctcatactctgcaggtcatcttaggttgcgagatgcaagaggacaactccacagagggatactggaagtacggctacgatggccaggaccacctggagttctgtccagataccctggattggcgggctgccgagccaagagcttggcctaccaaattagaatgggagagacacaaaattagagccaggcagaacagggcatacctggaacgagactgtccagcccaacttcagcagttgttggagctcggccggggagtgctggaccagcaagtacctcccctcgtgaaagtcactcaccatgtgagtcatccagcacagcctagcaaggaatcttag

SEQ ID NO: 2573 - DNA, 1281 bp, Artificial Sequence
  Description of Artificial Sequence: Synthetic coding sequence
atgggagaaccaggccagtcaccgagccctcgatcatcgcacggcagccctccgacactgagcaccttgactcttttgctgctgctctgcggccacgcccacagccagtgtaagattctgcgttgtaatgcagagtacgtgtccagcacactctccctgcggggagggggttcttcgggcgctctgcggggcggcggaggtggcggccggggagggggcgtggggtccgggggcttatgtcgcgccctcaggtcctacgccctgtgcactcggaggactgctaggacatgcaggggcgacctggcttttcattccgccgtccacggcattgaagatcttatgatccagcataactgttcccgccaagggcctacggctccccccccaccacgaggtccggccctacctggtgccggctcaggtctgcccgcccccgacccttgcgactacgagggccgcttttcacgcctgcacggtcggcctcccggctttctgcattgcgccagtttcggagaccctcatgtgaggagtttccaccatcattttcacacttgtagggtccaaggagcctggcctctgctggataacgattttttatttgtgcaggccacttctagccccatggctctcggcgctaacgccacagcgacacgcaagcttacgattatctttaagaatatgcaggagtgcattgatcagaaggtctatcaagcagaggttgacaatttaccagtcgcctttgaggatggttctattaacgggggcgataggcccggcgggtcctcattgagtatccagactgctaaccccggcaatcatgtggagattcaggcagcgtacatcggaacaacaattattatcaggcagaccgccggacaactaagctttagtattaaagtggcagaggacgtagctatggccttttcggccgagcaggacctccaattatgtgtggggggctgccccccttcgcaacgcctctcaaggtccgagagaaacaggcgtggagcaattactattgacactgcaaggcggctctgcaaggaagggctcccagtggaggacgcatattttcactcttgcgttttcgacgtgcttatcagcggtgaccccaacttcacagtagctgcccaggccgcacttgaggacgcaagagcctttttgccagacctggagaaactccatctctttccatctgacgctggagtccctctctcttcagcgaccctccttgccccactcctttcaggtctctttgtgttgtggctctgcattcagtag

SEQ ID NO: 2574 - DNA, 942 bp, Artificial Sequence
  Description of Artificial Sequence: Synthetic coding sequence
atgatccaacacaactgctctaggcaagggcctactgctcctcccccacctcggggtccagctttgcctggagcgggttctggactgcccgcccctgacccgtgtgactatgagggccggttctctaggctgcatggcagaccccccggatttctgcattgcgcatcattcggggatccacacgtcaggagcttccatcaccattttcatacctgcagggtgcagggggcctggccattactggacaacgactttctgttcgtccaggccacgagctccccaatggctctgggggccaacgcaacagccacccgaaaattgaccattatcttcaagaacatgcaggaatgcattgaccaaaaggtctaccaggctgaggtggacaatttgcctgttgctttcgaggacggtagcatcaatgggggcgatcggccgggtgggtcatcactctcaatccagaccgctaatcccgggaatcacgtcgagatacaggctgcgtatattggaacaacaatcattattaggcagacggccggccagctgagcttttctattaaggtggcagaagatgtagccatggcattctcggctgagcaggacctgcaactttgtgtgggaggctgccctccctcgcagagattatccaggtctgagcgaaataggaggggtgcaataacaatcgacaccgctcgccgattgtgtaaggaggggctccccgtggaagatgcctacttccattcctgtgtattcgacgttctcatatccggggatccaaatttcactgtcgcagcccaggcagccctggaggatgcacgcgcgtttctgccagacctggagaagctccacctcttcccctcagacgcaggagtcccgctctcatcagcaaccctgctggcaccccttctgagtgggctgttcgtgctgtggctctgtattcagtag

SEQ ID NO: 2575 - DNA, 282 bp, Artificial Sequence
  Description of Artificial Sequence: Synthetic coding sequence
atgggggaacccgggcagtccccatcgcctagaagctcccatggaagtccacccaccttaagtacccttacgctactgctcctgctgtgtggacatgcgcactcacaatgtaaaattctccggtgtaacgctgagtacgtgtcgagtacactgagcctccggggaggcgggtcttccggggccctgagagggggcggcggggggggtcgcggaggcggagtcggtagcggcggcctgtgtagggctcttcgttcatatgcactatgcaccagaagaacctag

SEQ ID NO: 2576 - DNA, 603 bp, Artificial Sequence
  Description of Artificial Sequence: Synthetic coding sequence
atgcaggagtgtatcgatcagaaggtgtaccaagccgaggtcgataaccttccagtggcctttgaagatggcagtataaatggcggggatcggcccgggggctcatccttatcaatacagactgccaaccccgggaaccacgtcgaaatccaggcagcttatattggcactacaattattattagacagactgctgggcaactgagcttctccatcaaagtggcagaggatgtggctatggcattcagtgcggagcaagacctgcagctgtgcgtgggcggctgccctcctagccagcgactctctcgcagcgagcggaataggcgcggtgcaataacaatcgatacagcgcggcgactgtgcaaggagggattgccggttgaagacgcgtattttcactcttgtgtgtttgacgtgctgatatccggcgaccccaactttaccgtggcagcccaggccgctctcgaagatgcgagggcctttctccccgatttggagaagctgcacttatttcctagtgatgccggggtcccactgtcttctgctacgctgctggctcctctgctgagtggcctctttgtgctgtggctgtgtatacaatag

SEQ ID NO: 2577 - DNA, 603 bp, Artificial Sequence
  Description of Artificial Sequence: Synthetic coding sequence
atgcaggagtgcatcgaccagaaagtgtaccaggccgaggtggacaatctaccagtggcattcgaggatggatcaatcaatggtggcgatagaccaggaggctcatccctatctattcagacggcaaaccctggtaatcacgtggagattcaagcggcatacattgggaccactatcatcattagacagacagcaggccagttgagcttcagcatcaaggtcgctgaagatgtcgctatggctttttctgccgagcaagaccttcagctgtgcgtcggcggatgccccccttcccagagactctccaggtcagaaagaaatagacgcggcgccatcaccatagacacggcgagaagactctgcaaggaaggtctcccagtggaagacgcctactttcactcttgcgtgtttgatgtccttatatccggtgatccaaacttcaccgttgcggcacaggccgccctcgaggacgctcgggcttttctacctgacttagagaagctgcacttgtttcccagtgacgccggcgtgcccctgagctctgctactctgctggcacccctgctgtccggcttattcgttctgtggctctgtattcagtag

SEQ ID NO: 2578 - DNA, 603 bp, Artificial Sequence
  Description of Artificial Sequence: Synthetic coding sequence
atgcaggagtgcatcgatcagaaagtataccaggccgaggtagacaatctccctgtcgcgtttgaggatggtagtattaatggcggagacagaccaggggggagtagcttatcaattcagacagcgaaccccggcaaccacgtggaaatccaggctgcatacatcgggaccacaattattataaggcaaacagccgggcagttgtcttttagcatcaaagtcgcagaggacgtggctatggcattctccgccgagcaggaccttcagctctgtgttggcggttgcccccctagtcagaggttgtctaggtctgaaagaaaccgaaggggggcgataaccattgacaccgcaagaagactctgcaaggaaggattgccggtggaggacgcctatttccattcttgcgtcttcgatgttttaatcagcggcgatcccaatttcacagtcgctgcccaggctgcactggaggatgccagagcgttcctgccggacctggagaaactccacctgtttcctagcgacgccggcgtgcctttgagcagcgccacgctgcttgcacctctgttgagcggtctgtttgtgttatggctttgcatccaatag

SEQ ID NO: 2579 - DNA, 603 bp, Artificial Sequence
  Description of Artificial Sequence: Synthetic coding sequence
atgcaagaatgtattgatcagaaggtgtaccaggccgaagtggacaacctgcccgtcgctttcgaggatggctctatcaatgggggcgatcggccaggcggtagctccctgtctatccaaaccgcaaaccctggaaatcacgtggagatccaggccgcttacattggtactactatcataatccgacaaacagccggacagctcagctttagcattaaggtggctgaggatgtagctatggcattttccgcagagcaggatctgcagctatgcgtaggagggtgtccaccatctcagagactcagccgaagcgagaggaaccgacgcggagctataaccatcgacaccgccagaaggttgtgtaaagaaggactgccggtcgaggatgcctattttcacagctgtgttttcgacgtgttgataagtggtgaccctaattttactgtcgccgcgcaggctgctctcgaggacgctagagcatttctgcctgacctcgagaaactgcatctctttcctagcgacgcgggcgtgccactgagttcagcaacactgctggccccactgctaagcggcttattcgtgctttggctgtgcatccagtag

SEQ ID NO: 2580 - DNA, 1905 bp, Artificial Sequence
  Description of Artificial Sequence: Synthetic coding sequence
atgccttcggacctggcaaagaagaaagcagccaaaaaaaaggaggcggcgaaagcgagacagcgaccacgcaaaggacacgaggagaacggagacgtcgtgaccgagcctcaggttgccgagaagaacgaagccaacgggcgtgagactaccgaagtggatctgctgaccaaggagctcgaggactttgagatgaaaaaagcagcagcacgggcagtaaccggagtactagccagccaccctaattctaccgatgtccatatcatcaatctgagccttacctttcatggccaggagctgctaagcgacactaagctcgagttaaattcaggcaggcgctatggcctgataggccttaatggaatcggaaagagcatgttgctttctgccataggaaaacgcgaagtgccaatccctgagcacatcgatatataccatctaaccagggagatgccgcctagtgacaaaactccactgcattgcgtcatggaagttgataccgaacgggccatgttggagaaagaggccgagcgcttagcacacgaggacgccgagtgtgagaagcttatggagctatacgagcgcctggaggagctggatgccgataaggcagagatgagggcgtcgcgcattctgcacgggttgggattcactccggctatgcaacgaaaaaagttgaaggacttctcaggcggatggcgcatgagagtggcactagctagggcactgtttattcgtcccttcatgctgcttctggatgagccaactaatcatttggatctcgacgcctgcgtctggctggaggaggaactgaaaactttcaagcggatcctcgttctagtgtctcattctcaagatttcctgaacggtgtgtgtacaaatatcatccacatgcataataagaagctgaagtactataccggaaactacgatcagtatgtcaagaccagattagagctcgaggagaaccagatgaagaggttccactgggaacaggaccagatcgcccacatgaagaactacattgcgcgcttcggccacggtagtgctaaattggcccggcaggcccagtcgaaggaaaagacccttcagaaaatgatggcttccggacttaccgagagggttgtgtctgacaaaactctgagcttttattttccaccatgcggaaaaatcccgccaccagtcataatggttcaaaacgtcagttttaagtacactaaggatggcccttgcatttacaataatctcgaatttgggatagatttagatacgagggtcgcgctcgtgggtccaaatggggcaggtaagtctaccttgctcaagctactcactggcgagctgctgccaacagatggaatgataagaaagcatagtcacgtgaagattggtcgctatcatcagcaccttcaggagcaactggacttggatctgagccccctcgaatatatgatgaaatgctatcctgaaatcaaagagaaagaggagatgcgcaaaattatcggccgatatggcctgacaggtaagcagcaggtgagtcctatacgcaatctatccgacggccagaaatgtagagtgtgcttagcttggctcgcctggcaaaatccccatatgctgttccttgacgaacccacaaatcatcttgacattgagacgatagatgcactggcagacgccattaacgagtttgagggaggaatgatgcttgtgtctcacgatttcagactcattcagcaagtggctcaggaaatttgggtttgtgagaaacagaccattactaaatggccaggcgacatcctggcatataaggagcacctgaaatctaagctggtcgacgaagaaccacagctcacaaaacgcacccacaacgtctgcacgttgaccttggcgtctctcccaagaccttag

SEQ ID NO: 2581 - DNA, 555 bp, Artificial Sequence
  Description of Artificial Sequence: Synthetic coding sequence
atgtgggtaacgaagttacttcccgcacttctgctacagcatgtgctgttgcaccttctgctcctgccaatcgccatcccgtacgccgaggggcagagaaagcgtagaaacacaattcacgagtttaaaaaatccgctaagaccactctcataaagattgatccagcactgaaaatcaagacaaaaaaagtgaacactgcagaccagtgcgcaaataggtgtacacgcaacaagggacttccttttacatgcaaggcctttgttttcgataaggccaggaagcagtgcttatggtttcctttcaattccatgagttcaggtgtgaagaaggaatttggtcacgaattcgacctttatgagaataaagactatatacgcaactgcattattggtaaaggcaggagctataagggcacggtttcaatcactaagtctggtataaagtgccagccctggagtagcatgatcccacatgagcattctggaggtgacgactgcctcgtggagagtaccttctactcgatccctttttggggccacaatagcgctaggtag

SEQ ID NO: 2582 - DNA, 891 bp, Artificial Sequence
  Description of Artificial Sequence: Synthetic coding sequence
atgtgggtcacaaagctactcccagctctcctactgcagcatgtgctcctgcacctcctgcttttacccatcgctattccttacgccgagggacagcgcaagcgtagaaatactatccacgaattcaagaaatccgccaagactacgctgattaaaattgatccagccctgaaaattaagaccaagaaggtaaacactgccgaccagtgcgctaatcgctgcacccgaaataaaggactgccctttacatgcaaagcattcgtcttcgacaaggctagaaaacagtgtctttggtttcctttcaatagtatgagcagcggtgtaaagaaggagtttggtcatgagtttgatctttatgaaaataaggactacatccgaaactgcattatcgggaaggggagaagctacaagggcaccgtttcgatcactaagtcaggcatcaagtgccagccctggtcatcaatgatacctcatgaacattcatttctcccatcctcatatagaggaaaagacctccaggagaactattgccggaaccctcggggcgaggagggggggccatggtgttttacatctaatccggaggtgcggtatgaggtttgtgatatccctcagtgctcggaggtggagtgcatgacttgcaacggagagagttacagggggttgatggatcacactgagtcaggaaaaatctgccagcggtgggaccaccagactccccatcggcataaatttttacccgagagatatcctgacaaaggcttcgacgacaattattgtcgaaaccccgacggccagcccagaccctggtgctacacccttgacccacatacccggtgggaatactgtgcaatcaagacttgcggcgacataacctgggccctaaattag

SEQ ID NO: 2583 - DNA, 426 bp, Artificial Sequence
  Description of Artificial Sequence: Synthetic coding sequence
atgtgggtgacaaagctcctgccagctctgctgctccagcatgtgttactgcacctgttgctgttgccaatcgctataccttacgctgaaggccaaaggaaacggcgtaacacaatccacgagtttaaaaaaagcgccaagacaaccctgatcaagattgatccagccttgaagattaaaaccaaaaaggtgaacacagctgaccagtgtgccaaccgatgcaccaggaataagggcctgccttttacctgcaaggccttcgtgtttgataaggctaggaaacaatgtctttggtttcctttcaattcgatgagctccggggtcaagaaggagttcggtcatgagttcgacctgtacgagaataaagattatatcagaaactgcataatcgggaaaggccgcagttacaagggcaccgtttcttag

SEQ ID NO: 2584 - DNA, 357 bp, Artificial Sequence
  Description of Artificial Sequence: Synthetic coding sequence
atgtgggttaccaagttgctaccggctctccttttgcaacacgtccttctccaccttctgctactcccaatagcaataccctacgccgaaggacagcgcaagcgcaggaacactattcatgagtttaaaaaaagtgcaaagactacattaattaagatcgatccagccctgaagatcaagaccaagaaggtgaatactgcagaccagtgtgcgaatagatgcacccggaacaagggccttccctttacttgcaaggcttttgttttcgataaagcgaggaagcagtgtctgtggtttccctttaactctatgtcttccggcgtaaagaaggaattcggtcacgagttcgatttgtag

SEQ ID NO: 2585 - DNA, 633 bp, Artificial Sequence
  Description of Artificial Sequence: Synthetic coding sequence
atgtgggtgacaaagttactacctgccttgctcctgcagcatgtgctcttgcatttacttcttctgcccattgccatcccctatgcagagggccagcgcaagcggaggaataccattcacgaattcaagaagtctgcaaaaaccacccttatcaaaattgacccggcgctgaagatcaagacaaagaaggtgaataccgctgaccaatgtgcaaaccgatgcaccagaaataaggggctgcctttcacctgcaaggccttcgtgtttgataaagcccgcaagcaatgtctgtggtttcctttcaactctatgagctcgggagttaaaaaagaatttggccacgaatttgacttatacgagaacaaagattacatcaggaactgcataattggtaaggggagatcctacaagggcactgtaagcatcacaaaaagtggcatcaaatgtcaaccttggtcgtccatgataccgcacgaacatagcttcctccctagctcctatagaggaaaagacctccaggagaactactgtcgcaacccaaggggggaggaagggggaccctggtgcttcacttctaatcctgaggtgagatacgaggtatgcgatatcccacagtgtagcgagggaaagtag

SEQ ID NO: 2586 - DNA, 873 bp, Artificial Sequence
  Description of Artificial Sequence: Synthetic coding sequence
atgtgggtcaccaagctactgcccgcactcctactgcaacatgtcctccttcacctgctactcctgcctattgccatcccttacgccgaaggccaacgaaagcgccgtaacaccatccacgagtttaagaagtcagccaaaactactcttatcaagatagaccctgctttaaaaatcaagacgaaaaaggtgaacactgcagaccagtgcgctaacagatgtacccgaaataagggtttgcctttcacctgcaaagcattcgtgtttgataaggcacgcaagcagtgcctatggttcccattcaactcaatgagttccggagtcaaaaaagagttcggccatgaattcgacctctacgagaataaggattacattcgcaactgtatcattgggaaggggcgcagctataagggaactgtgtctataacgaagagtggcataaagtgtcaaccctggtcaagtatgatccctcacgagcacagctttcttcccagtagctacaggggcaaggatttgcaggagaattactgtcgaaatccacgcggggaggagggggggccatggtgctttacctccaatccagaggtccggtatgaggtgtgtgatatcccacagtgcagtgaggtggagtgtatgacctgcaatggtgagagttaccgcggattgatggatcacacagaatcaggaaagatctgtcagcgctgggatcaccaaactccccatcggcacaagttcttacccgagagataccccgataaaggattcgacgacaattactgcagaaatccagacggacagccacgcccctggtgctacacgctggatcctcacactaggtgggagtattgcgccatcaaaacctgcgagacatag

SEQ ID NO: 2587 - DNA, 858 bp, Artificial Sequence
  Description of Artificial Sequence: Synthetic coding sequence
atgtgggtcaccaaactgctgcccgccctgctgctacagcatgtgttgttgcacttgctcctcctgccaattgccattccttatgcagaggggcagcgcaaaagaagaaatacaatccacgagtttaagaagagcgccaagactacacttatcaaaattgatcctgctttgaagatcaaaaccaaaaaggtgaatactgctgaccagtgtgccaaccgttgtacccggaataaaggtttacccttcacctgcaaggctttcgtgtttgacaaggcccgcaagcagtgcttgtggttcccattcaactctatgtcaagcggtgtgaagaaagagtttggccacgaattcgatctgtacgaaaacaaggattatattcggaactgcatcatcgggaaaggtaggtcttataagggcactgtctcgataacaaagtcaggtatcaaatgtcaaccctggtcctctatgattccacatgagcattcataccgcggtaaggatctgcaggaaaactactgccgaaacccacggggcgaggaaggtggcccatggtgtttcacctccaacccagaagtcaggtatgaagtatgtgatatacctcaatgttccgaagtggagtgcatgacatgtaatggagaatcctataggggattgatggaccataccgaaagtggaaagatctgtcagcggtgggaccaccagacccctcatagacacaagttcttgccagagcgctatcctgataagggcttcgatgacaactactgtagaaatcccgatggccaaccgagaccttggtgttacaccctcgacccccacactagatgggagtactgcgcaataaagacttgcgagacatag

SEQ ID NO: 2588 - DNA, 2172 bp, Artificial Sequence
  Description of Artificial Sequence: Synthetic coding sequence
atgtgggtaacgaaactgttgcctgcccttttactgcaacacgttctgctccacctacttttactgcctatcgccataccatacgcagaaggccaacgcaaacggcgcaacacgattcacgagttcaaaaagtccgctaagactactttaattaaaatcgacccagcactcaagataaagacgaagaaggtgaacaccgctgatcaatgcgcaaaccgctgtaccagaaacaaaggtctgcccttcacctgtaaggcatttgtgttcgataaggcacgaaaacagtgtctttggttcccgttcaacagcatgtcctcaggagtgaagaaagaattcggccacgagttcgatctctatgagaataaagattatatcaggaactgtattatcggtaagggcagatcatataagggcaccgtgagtattactaagtccgggatcaagtgccaaccctggtcatctatgatccctcatgagcattcctaccgcggcaaggatctgcaggaaaactattgtcgaaatcctagaggtgaggaggggggaccctggtgcttcacttccaacccagaggtcagatatgaggtttgcgatattccacagtgttctgaggtggagtgcatgacctgcaatggtgaatcttataggggcctgatggatcacacagaatccgggaaaatctgtcaacgctgggaccaccagacaccccacaggcataagtttctccccgagcgctatccagacaaaggattcgacgacaactactgtagaaacccagacggtcagcctcgcccatggtgctacacccttgatccacatacacgttgggagtactgtgccatcaagacctgtgcagacaatactatgaacgacaccgacgtgcctcttgagactaccgagtgcatccagggtcagggtgagggctatcgcggaaccgtgaacaccatttggaacggaattccgtgccagcgctgggacagccagtaccctcatgaacatgacatgacacctgagaacttcaaatgcaaagaccttcgtgagaactattgtagaaatccggacggctctgagagtccttggtgctttacgactgaccccaacatacgtgtaggatattgttcacagattcccaactgtgacatgtcccatggccaggattgttacagggggaatggtaaaaattacatgggaaatctgtcacagacccgctcgggtctgacctgttcaatgtgggataagaacatggaagacttacatcgccacattttctgggaaccagatgcaagcaagctgaacgagaattattgccgcaacccggacgacgatgcgcacggtccttggtgctatacgggaaaccccctcattccatgggactattgcccaatctctaggtgtgagggggacactacacccacgattgtgaatctggaccacccagtaatatcctgcgcgaagaccaagcaactcagggttgtcaatgggatccccacccggacaaatataggctggatggtttctctgcgctacagaaataaacacatctgtggtggctccctgataaaagaaagttgggtgctgacagctaggcaatgctttccctcgagggaccttaaggactatgaggcatggctgggaatccacgatgtgcacgggagaggtgacgaaaagtgcaagcaggtgctgaatgtaagtcagctcgtctatgggcccgagggcagcgatctagtcctcatgaagctggccagacctgccgtcctggatgactttgtaagtactatcgatctgcccaattacggatgtaccatccccgagaaaacgtcttgcagcgtatacggctggggctacacgggactgatcaactatgacggattgttgcgggtagcacatctatacatcatgggtaatgaaaagtgtagccagcatcacagagggaaggtgacattgaatgagagtgagatatgcgccggtgcggaaaaaatcggttccggcccatgcgaaggagactatggcggtcccctggtctgcgagcagcacaagatgaggatggtgcttggcgttatagtgccgggacgaggttgcgctattcccaatcgacccgggatattcgttcgagtggcttactacgccaaatggattcacaagattattctgacgtataaagtcccacagtcttag

SEQ ID NO: 2589 - DNA, 363 bp, Artificial Sequence
  Description of Artificial Sequence: Synthetic coding sequence
atgaacggggaggagaaatcatgttccgggtacggaggcccggatgcaatggatggaaaacttgtgtcttctgacgacgatgacttcatcgtcaaacgggaacacacccgagcttccggaatccgcaaggccgtgcttagcgggcctggacagagtgcagagaacgaaaccgaccaggttaactttcgcgagatcccccccagatgttatcctaagcacgcaaaagcctgcatctacttcacctacaaggtacattattccaactcttcaactgagatacctgaatttctcaccgctctggaggtactgatggccagcgactttctggacatctacattttcttgttctttttgttcttctag

SEQ ID NO: 2590 - DNA, 255 bp, Artificial Sequence
  Description of Artificial Sequence: Synthetic coding sequence
atggctctgagctcccaaatctgggcagcgtgtctgctattgcttctcctcctggcttcgctcacatctggtagcgtgttcccacaacaaacgggacagctggcagagttgcagccacaggacagagcaggcgctcgcgcctcctggatgcctatgttccagcgtcgacggcggagggatacacattttcccatttgcatcttttgctgtggctgctgtcaccggagtaaatgtggcatgtgctgcaagacctag

SEQ ID NO: 2591 - DNA, 1422 bp, Artificial Sequence
  Description of Artificial Sequence: Synthetic coding sequence
atggccgtaatggcacctcgaacccttgtgttactgttgagcggggccctcgcacttactcaaacatgggccgaagtgcagctcgtggaatcaggtggtggcctggtgcagcctgggggttcactgcgtctctcttgtgccgccagcggttttaacatcaaggatacctatatacattgggttagacaagcaccaggaaagggactggaatgggttgccagaatttatccgaccaatggttacactcgttacgccgacagcgtgaaaggtcgtttcactatcagcgccgatacgtccaagaatactgcttacctacagatgaactccctccgggcagaagatacagctgtgtactactgttcaagatgggggggtgacggcttctatgccatggattactggggacagggaacgttggtgactgtatccagtgccagcacaaagggcccatctgttttccccctagcgccatccagcaagtccacttccgggggcacagccgctctcggctgtctggttaaagactactttcccgagccagtcaccgtgtcttggaatagcggcgcgttgacctcaggagtgcacacctttccagctgtcctgcagtcctctggactgtactcactcagcagcgtggtgactgtgccatcatcaagcctgggaacacagacctacatctgcaacgtaaaccacaagcctagtaataccaaggttgataaaaaagtcgagcctaaatcatgtgataagactcacacttgccctccctgtcctgcacctgagcttctcggcggtccttcagtttttttatttcctcccaaaccaaaggacacactgatgatctctcggacccctgaagttacgtgcgtggtggtggatgttagccacgaagaccctgaggtgaagttcaattggtacgtagacggcgtcgaggttcacaatgccaagacgaagccgcgcgaggagcagtataatagtacctatcgcgtcgtctccgttctaacagtgttgcaccaggactggctgaacggcaaggagtacaaatgcaaggtatccaataaagctctgccagcgccgattgaaaagactatcagcaaggccaagggtcagcctagggaaccgcaggtgtatactctacccccttcccgagacgaattgactaagaatcaagtcagcctgacttgtctggtaaagggattttacccctccgacatcgccgttgaatgggagagtaacggtcagcccgagaataactataaaaccaccccaccagtccttgactccgatgggagcttcttcctgtatagtaagttaaccgtggacaagtctagatggcaacaggggaatgtctttagctgttcagtcatgcacgaagcactgcataaccattatacccagaaatctctgagcctgtctcccggctag

SEQ ID NO: 2592 - DNA, 717 bp, Artificial Sequence
  Description of Artificial Sequence: Synthetic coding sequence
atggccgtgatggcaccccggaccctcgttctgctcttatccggagctttggcactaacgcaaacctgggccgacattcaaatgactcagtccccttcaagcctgagcgccagtgtcggcgaccgggtgacaattacctgcagagcttcccaggacgtgaatacagccgttgcttggtatcagcagaagcccggcaaggctcccaagctcctgatttatagcgcatcatttttgtactccggtgtaccatcccggttcagcgggagccgcagtgggacagacttcacactgaccataagttccctgcagcctgaggactttgctacctattattgccaacaacactatacaactcctcccacatttgggcagggcacaaaggttgaaatcaaaaggaccgtggccgccccttcagtgttcatatttcccccaagtgatgaacagctgaaaagtggtaccgcttctgtggtgtgcctgctcaacaacttttatccaagggaggcgaaagttcagtggaaggttgataatgcactacagtcaggtaactcccaggaaagcgtgaccgaacaggatagcaaggacagcacttacagtttatcctctacactcacgctaagcaaagccgattatgaaaaacacaaggtctacgcgtgcgaggtgacacaccaaggtctgtcaagtcccgtgaccaagtctttcaacagaggagagtgttag

SEQ ID NO: 2593 - DNA, 657 bp, Artificial Sequence
  Description of Artificial Sequence: Synthetic coding sequence
atggccaccaggtctcccggcgtcgtcatcagcgatgatgaacccgggtatgatcttgacctgttttgtattccgaaccactacgcagaggatctagagagagtcttcatccctcacgggcttattatggacagaaccgaacggctcgcgagagacgttatgaaggagatgggaggtcatcacatagtggccctgtgcgtattgaagggcggctataaattttttgccgaccttctcgactatatcaaggcactaaacagaaacagcgacagatcaatcccaatgaccgtcgacttcatccgcctgaagtcatattgtaacgatcagagcactggagatatcaaggtgattgggggcgatgatctttctaccttgaccggcaagaatgtcttaatcgtcgaggacatcatcgataccgggaagactatgcagaccctactcagcctcgtgcggcaatacaaccctaagatggtgaaggttgcctcactgttagtgaagcggacacccagatcggtcggatacaaaccagatttcgtcggatttgaaattcccgataagtttgtcgttggctatgcacttgattataacgagtatttcagggatctgaaccatgtgtgcgtaattagtgagactggtaaggccaagtataaggcatag

SEQ ID NO: 2594 - DNA, 657 bp, Artificial Sequence
  Description of Artificial Sequence: Synthetic coding sequence
atggcgacgcgatcgcctggtgtggttatttccgatgatgagccagggtatgacctggatttattctgcattcccaaccattacgctgaagacctcgagcgcgtctttattcctcacggtctcataatggataggaccgaacggctcgcccgggacgtgatgaaggagatgggcgggcaccacattgtagctctatgtgtgttaaaggggggttacaaatttttcgctgacctcttagattatataaaagccctgaacaggaacagcgatcgaagtatccctatgacagtagacttcatccggctcaagtcttattgcaatgaccagtcaacaggtgacattaaggtgatcggcggagacgacctctcaactctgacaggcaaatctcgcctcctcgctgaagacataatcgatacgggtaagactatgcaaaccttgctctctcttgtgcgacaatacaatcctaagatggtcaaggtcgccagcctgctggtgaagcgaactccaagatctgtcggatacaagcccgactttgtgggcttcgagatccctgacaaattcgtggtgggatacgcgctcgattataatgagtactttcgggatctcaaccatgtgtgtgtgatcagtgaaaccggaaaagccaaatataaggcttag

SEQ ID NO: 2595 - DNA, 1653 bp, Artificial Sequence
  Description of Artificial Sequence: Synthetic coding sequence
atgcccccacccagaaccggccgcggcttactttggctcggactcgtgctcagtagcgtttgcgtcgcccttggctcggaaacccaggcaaactctactaccgatgctttaaatgttctgctgatcatagttgacgacctccgtccaagccttggttgctatggagacaaactggttcgctctcccaacatcgaccagctcgccagccacagtctgctgttccaaaacgccttcgctcagcaagccgtgtgtgctccctcaagagtctctttcttaacaggacggagaccagatacaacaaggctgtatgactttaactcctattggagagtgcatgcaggtaactttagtactattccacaatacttcaaggagaacgggtacgttactatgtccgtcggcaaggtcttccaccccggcattagttcaaatcataccgatgattctccttatagctggagcttcccaccgtaccacccgtcgagcgaaaagtatgaaaataccaagacctgtcgggggcccgatggggaactgcacgctaatctgttgtgtcctgtggacgtgctggatgtcccagagggcaccctccccgacaaacagtctacagaacaagctattcagttgctcgagaaaatgaagacatctgcctctccttttttcctggcagtaggctaccataagcctcatattcctttccgctatccaaaggaatttcagaaattgtacccactggaaaatatcaccttggctcccgatcctgaggtcccagatggactgccacctgtcgcctataatccttggatggacataagacagcgtgaggacgtacaggccttgaacatcagtgtcccctatggcccgatccctgttgacttccaacgcaagatacggcaatcgtactttgcctccgtctcatacctagacacccaggtaggtagattgcttagtgccctggacgacctccagttggcgaacagcaccatcatcgcgtttacatctgatcacggatgggctttaggcgagcacggtgagtgggcgaagtacagtaactttgacgttgccacccatgtgcctcttatcttctacgtgcctggaaggactgcttctcttcccgaggctggtgaaaaactgttcccttatctggatcctttcgactcagccagccagttaatggagcccggccgtcaaagcatggatcttgtggaactggtgtcattgtttcccactttagcgggactggccggtcttcaggtccctcctaggtgccccgtgcctagttttcatgtcgaactgtgtcgcgagggcaagaaccttctgaaacacttccgttttcgcgacctggaagaggatccttaccttcccgggaacccgagggaactgattgcttatagccagtatccacgcccaagtgacatacctcagtggaactctgacaagccgtccctgaaagacattaagatcatgggctactccatacggaccatagattatagatacacagtgtgggtaggctttaatccggacgagtttcttgccaactttagcgatattcacgcgggggagctctactttgtagattccgatcctcttcaggatcacaacatgtacaacgatagccaaggcggagatttgttccagttgttaatgccctag

SEQ ID NO: 2596 - DNA, 1032 bp, Artificial Sequence
  Description of Artificial Sequence: Synthetic coding sequence
atgccgcctcccaggacgggccgggggctactctggctgggccttgtgttgagctctgtctgcgtggcgcttggctctgagacccaagctaatagcactacagatgccttgaacgttctgttaatcatcgttgatgatctgagacctagcctcggctgttacggcgataagttggtgcggagtccaaacattgatcagctggcatctcactctctgctttttcagaatgcctttgcccagcaggccgtctgtgctccgtcccgcgtgtccttccttactgggaggagacccgatactacacgcttgtacgatttcaactcttattggagggtgcacgccgggaactttagcactattcctcagtatttcaaggaaaatggatatgttacaatgagcgtggggaaggtgtttcatcccgggatatcctccaaccacacagacgacagcccctactcctggtcctttccgccataccatccgtcaagcgagaagtatgagaataccaagacctgtcggggcccagatggcgaactacacgccaaccttctttgtccagtggacgtcctcgacgtgccggaaggcaccctccccgacaagcaatcaacagagcaggccatacaacttttggagaaaatgaaaacctccgcgagccccttttttctcgcagtaggctatcataagccccacatcccttttagataccccaaagaattccaaaagttataccctctcgagaacattactctggctccagatcccgaagtcccagacggtttgcctcccgtcgcttataacccctggatggatatccgacagagggaggacgtgcaggctctgaacatcagcgttccctatggcccaatccccgtggacttccagagaaaaattcgccagtcctactttgcttccgtctcataccttgatacacaggtaggcagactcttaagcgccttagatgatctgcagctcgccaatagtacgattattgcgttcacctccgaccatggctttctgatgaggaccaacacctag

SEQ ID NO: 2597 - DNA, 939 bp, Artificial Sequence
  Description of Artificial Sequence: Synthetic coding sequence
atgccaccgccaagaacaggtcggggcctgctgtggctcgggttagtgctgtctagcgtgtgtgtggccctcggtagtgagacacaggccaatagcacaaccgacgcactgaacgtgctgttgatcatcgtcgatgatctacgtccgtctttagggtgctatggcgacaagctggtacggtcccccaacatagaccaattagcctctcactcactacttttccaaaacgctttcgcccaacaggccgtgtgtgcgcctagccgagtttcctttctgaccggcagacgacctgatacaacgcggctgtacgatttcaatagctactggagggtccacgccgggaacttttccactattccacagtacttcaaagagaacgggtacgttaccatgtctgtcggcaaggtgtttcatccaggaattagcagtaaccacacggatgacagcccttattcttggagttttcctccctaccacccctcctctgagaaatacgaaaacaccaaaacatgtagaggacccgacggagagctccacgccaatctgttgtgccccgtggatgttctggacgtgcccgaaggcactctcccagataaacaatcgaccgaacaggccatacaactcctggagaaaatgaagacaagcgcctctccctttttcctggccgtgggatatcacaagccacacatcccatttcgataccctaaggagttccagaaactctatcctctggaaaacataactttggccccagaccctgaagtcccagacggtcttccaccagttgcttacaacccgtggatggatatcagacagagagaagacgttcaagccctaaacatctccgtcccctacggacctatcccagtcgatttccaggaggatcaatccagtaccgggtttcgactcaagacaagctccacacggaaatacaagtag

SEQ ID NO: 2598 - DNA, 540 bp, Artificial Sequence
  Description of Artificial Sequence: Synthetic coding sequence
atgccccccccccgcaccggccgaggtctgctttggctaggcctcgttctgtccagtgtttgtgtcgccctggggtctgagactcaagccaactctacaactgatgcccttaacgtactgctgattatcgtcgatgacttacgaccctctctgggctgttatggggataagctggtcagatcacctaatattgatcagctcgccagtcattccctgctgtttcagaatgcattcgcgcagcaggctgtctgtgccccgagtcgggtgtccttcctgaccgggagaagacccgatactacacgcctgtatgattttaactcatactggagggtgcacgcagggaacttttcaaccatacctcagtactttaaggagaatggatacgtcacaatgagcgtgggcaaggtgttccatcccggaacagctccctgtccagagtctggcttctcttggtttgtggtgagcgagtcctccattcccatcctggggatgggactgtcactgcagtcaccgctgttagccggacgcgtgccccggtag

SEQ ID NO: 2599 - DNA, 261 bp, Artificial Sequence
  Description of Artificial Sequence: Synthetic coding sequence
atgccaccaccaagaacaggacgagggctcctgtggctcgggcttgtcctgtcaagcgtgtgcgtggctctggggtccgaaacccaggctaactccactacggacgcattgaatgtgctgttgatcatcgtggacgacctgcgtccaagccttggatgttacggcgataaactggtcagatcccccaatattgatcagctggcgtcacatagtctgctgttccagaacgctttcgcccagcaggctgtttgcgcgccctag

SEQ ID NO: 2600 - DNA, 462 bp, Artificial Sequence
  Description of Artificial Sequence: Synthetic coding sequence
atggacctcgtggagctggtgtccctcttcccaacactggccgggcttgccggcctgcaggtgccacccagatgtccagtgccgtcattccacgtggaactctgcagagaagggaaaaatctccttaagcattttcgcttcagggatctggaggaagacccttatttgccagggaatcctcgagaactaattgcttatagccagtaccctcggccaagcgacatacctcaatggaactctgacaaaccaagcctaaaggacatcaagattatgggctatagcatcaggaccatcgattaccggtacactgtctgggtgggttttaaccctgacgagttcttagctaatttttccgatatccacgccggcgaattgtactttgtggacagtgacccgctacaggaccacaacatgtacaatgactcacagggcggggacttattccagttgctcatgccttag

SEQ ID NO: 2601 - DNA, 1020 bp, Artificial Sequence
  Description of Artificial Sequence: Synthetic coding sequence
atgaaaacgagcgcttccccttttttcctcgctgttggttaccataaaccacacatccccttccgttatccaaaggagttccagaagctgtatccgctggaaaacattaccctcgcaccggatcctgaagtccctgatgggctcccacctgtcgcctacaacccatggatggacatcaggcagagagaagacgtgcaggcattaaacatctctgtgccctatggaccaatccccgtcgattttcagcggaaaatccgccagagttatttcgcatccgtgtcttacttggacacgcaagtgggacgactcctgtcagctctggacgaccttcaactcgctaactcgaccattattgcgttcacctcggatcatggctgggctctcggcgaacatggcgagtgggcaaaatatagcaattttgacgtggctacccatgtacctctcattttttatgttccagggcgtaccgcctctctgcccgaggcaggcgagaaattgttcccttatctggaccccttcgacagcgcgagtcagcttatggaaccgggtagacagtctatggacctggttgaacttgtctctttgtttcctacgctggctggcttggccgggttacaggttccccctaggtgccccgttccaagttttcatgttgaactctgtcgggaaggaaagaacctgctcaaacatttcaggttccgggatctagaagaagatccataccttccggggaatcctcgggaactgatcgcctactcccaataccctagaccatccgacattccccagtggaactctgataagccttcgttaaaggatatcaaaattatgggatatagtatccgcactatcgattacagatacacagtgtgggttgggttcaatccagacgagttccttgccaacttctcagacatacacgctggtgagctgtattttgtggacagtgatccacttcaggaccacaatatgtataacgacagccagggcggagaccttttccagctgttgatgccttag

SEQ ID NO: 2602 - DNA, 1962 bp, Artificial Sequence
  Description of Artificial Sequence: Synthetic coding sequence
atgcggcctcttcgacccagggcagccttgctcgctttgctagcttccttgctggcggcacccccagtcgcccctgccgaggcccctcatcttgttcatgttgatgcagcacgggccttgtggccactcagacgtttttggcggagcaccggattctgtcccccactgccccactcccaggctgaccaatacgtgctgtcttgggaccagcagttaaatttggcttacgtcggcgcagtcccccacaggggaattaaacaggtgcggactcattggctgctggaactggtgaccaccagaggttcgactggccgcggactgtcctacaacttcacgcacctggatgggtatctcgacttgctcagggaaaaccaactcctcccaggctttgaactcatgggcagtgcttctggacacttcaccgacttcgaggacaaacagcaggtgtttgagtggaaggacctggtgtcctctctagctcgacggtacattgggcgctatggccttgcccatgtgtcgaaatggaactttgaaacatggaatgaacccgaccaccatgatttcgacaatgtgtcaatgaccatgcaggggttcttgaactactacgatgcctgctctgaaggcctgagagctgcatctcccgccttacgcctgggcggtcctggcgacagcttccatacacctccaagatctcccctctcctggggcttgctcagacattgtcacgacggaactaactttttcacaggtgaagcgggtgtacgactggattacatctccctgcatcgaaaaggcgcccggtcctccatttccatcctcgagcaagaaaaggtggtggctcagcagatccgccaattattccccaaattcgcagacacccccatctacaacgatgaagccgatcccctggtgggatggagcttacctcaaccttggcgcgccgatgttacctatgccgccatggttgttaaagtcatcgcccagcatcagaacctgctgctggctaacactacctctgcttttccatacgcactgcttagcaatgataacgcttttctgtcctaccatccccatccattcgcccaaaggaccttgacagccagattccaggtgaacaacaccagaccaccacatgtgcagctactccgaaaacctgtactgactgccatgggcttactggctctgttagacgaagaacagctgtgggcagaggtcagccaggcaggcacggtgctggacagcaatcataccgtgggtgtgctcgcttctgctcaccgccctcagggccccgctgatgcttggcgggccgccgtcctgatctacgcttctgatgacacccgtgcccaccctaatcgctcggtggccgtcacactccgactgagaggtgtgccccccggacctgggttagtatatgtgactagatatctagacaatggtctgtgcagccccgatggggaatggagacgccttggaagaccggtgttccctacagcagagcaattccgtcggatgcgagctgcggaagatcccgttgcagccgctccacggccgcttccggccggcggacgtctgacactcaggcccgcgttgcgccttccctccctgttgttagtgcatgtttgtgcacggccagagaagccacccggacaggtcactcgactgagggcccttcctctgacccagggacagctggttttagtgtggtcggatgagcatgttggtagtaagtgcctgtggacttacgagatccagttcagccaggatggaaaggcttacaccccagtttccagaaaacccagcaccttcaatctgtttgtgttcagcccagataccggagccgttagcggtagctacagggtacgtgccttagattactgggcccgtccaggtcccttttctgatccagtgccctatctggaggtacccgtacctcgggggccgcctagccctgggaacccctag

SEQ ID NO: 2603 - DNA, 2028 bp, Artificial Sequence
  Description of Artificial Sequence: Synthetic coding sequence
atgcgaccactgcgcccccgcgcagctctacttgctctcttggcctccctgctcgcggcaccccctgtggccccagctgaggccccacacctggttcacgtagacgcagccagggctttgtggccgctgcgcaggttttggagaagtacaggcttttggggcagtaccggacgtggactctcctataacttcactcatctggacggctacctcgacttgctgagggagaaccaattgttgcctgggtttgaactcatgggcagtgccagtgggcacttcacagactttgaggataagcagcaggtgtttgagtggaaggacctcgtctcctcactggctcgtcgctatattggcagatacggcctggcccacgtgagtaaatggaactttgaaacctggaatgaaccggatcaccacgatttcgacaatgtgtccatgactatgcaaggcttcctgaactattacgacgcctgttcagagggcttacgggcagcctctccagccctgaggctgggtggtcctggagatagtttccatacaccgccacgctcccccttatcttggggactcctcagacactgtcatgatgggacaaacttttttaccggagaagccggggtgcggctcgattatatcagcctccacagaaaagtgcggccagccccaccttccgctcctgtcttctgtgctttgagtcgctgtgcgcccggacgtgccgatccaggcggtgcagaggccgcacccccggctggctgtgcccagcttcacctccacccaggtgccggagaggggcggcgcgctgccgaccctgcagctctgcctcaggtacgcgggcatcctcatctgcaaagacggggaggtccagctgggggactcgtgccggctactgctgtggagggaggaagagacctgcgaggtcacggaggcgaaggaggacccgcccagaggccagcacgacctcctgcaactttcctgccaagacgcgaccgaagggccgtggctgccccacctggaccatcatgtcctgggcaccctcaagttatcgctcaacatcaaaacctgctgctggccaacacaacatccgcttttccttacgctctgctcagcaacgacaacgcttttctctcatatcatcctcacccctttgcacagcgaaccctgactgcacgttttcaagtcaataacactagaccaccgcacgtgcagctgttgaggaagcccgtacttacagccatgggactgctcgccctccttgatgaggagcagctttgggccgaggtgtcccaggccggtacagttctcgatagcaatcacacagtgggcgtgttggctagcgcacacaggcctcagggaccagcggacgcctggcgcgccgctgtgctcatttacgcgagcgatgacacccgagcacatcctaacagatccgtggccgtgaccctgcgacttcggggcgttcccccaggcccaggactagtatacgtcacccgctatcttgataacggactatgttctccagacggtgagtggaggcggctgggacggcccgtctttcctactgccgaacagtttcgtcggatgcgggcggcagaggatccagttgctgctgcccctcgaccactccccgcgggtggaaggctaacactgcgacccgccctcagactcccaagcctcctcttggttcacgtgtgcgctcgtccagagaagccacccggccaggtaacccgactccgggccctgcctctcactcaggggcaacttgtcctagtatggagcgatgagcacgtgggatcgaagtgtctgtggacatacgaaatccagttttctcaggatggtaaggcctacacacctgtctcgcgaaaaccgtcgaccttcaatctgttcgtgttctctcctgacacaggcgccgtatccggcagctatcgtgtacgggcactggactattgggcacggccagggcccttctcagaccctgtgccctacctggaggtgcctgtgccaagaggacccccgtccccgggaaatccgtag

SEQ ID NO: 2604 - DNA, 603 bp, Artificial Sequence
  Description of Artificial Sequence: Synthetic coding sequence
atggcactatggatgcgactcctccctcttcttgcactgctggccctgtggggacccgatccagccgctgcatttgtgaaccagcacctctgtggatcacacctggtcgaggcactgtacctggtgtgtggagaacgcgggtttttttatacccccaaaacacggcgcgaggccgaagacctgcaggcaagcgcccttagcctttcttcctctacatcaacatggccagaggggctggacgctaccgccagggctccaccagcattggtcgtcaccgcaaatattggccaggccggggggagttcttcacgccagttccgccagagagcattgggaacgtcggatagtcccgtcctcttcatccactgtcccggtgcagccggcactgcccaagggctagagtatcgggggcggagggtgaccacggagctggtttgggaggaagtggattcctcaccgcagcctcaggggtctgagtcacttccagcccagcctccagcccagcctgctccccagccagaaccccagcaggcacgagaaccatcccccgaagtctcatgctgtggtctttggccaagaaggccccagcgctctcagaattag

SEQ ID NO: 2605 - DNA, 333 bp, Artificial Sequence
  Description of Artificial Sequence: Synthetic coding sequence
atggctctgtggatgcggctcctgccgttgttggctctgctggccctttggggccctgaccctgctgccgcgttcgtaaaccaacacctgtgcggttcacatctcgtcgaggccctgtatttggtgtgcggcgaaaggggttttttctacacgccaaaaacacggcgcgaggctgaagatctgcaggtggggcaagtcgagctaggaggcgggccaggggctggctccctgcagcccttggctctggagggctccttgcagaagcgaggaattgtggaacagtgctgtacatcaatctgttcactctatcagcttgagaactactgcaactag

SEQ ID NO: 2606 - DNA, 333 bp, Artificial Sequence
  Description of Artificial Sequence: Synthetic coding sequence
atggccctctggatgcgtcttttacccctgcttgctctcctagcactctggggtcctgatcccgctgctgcgtttgtgaatcagcacctgtgtggctcccacctggtcgaggccttatatcttgtgtgtggcgagcggggttttttttataccccaaagacccggcgcgaggccgaggacctgcaggttggacaggtggagctgggcggggggccgggagctggaagcctgcaaccactggcactagaggggtctttgcagaaacgcggaatagtggagcagtgctgcaccagcatctgctcgctgtatcaactggagaactactgcaactag

SEQ ID NO: 2607 - DNA, 333 bp, Artificial Sequence
  Description of Artificial Sequence: Synthetic coding sequence
atggccctgtggatgaggctcctaccccttctcgcactactggccctgtggggccccgatccggccgctgcgttcgttaatcagcacctgtgtgggtctcacctcgtcgaggccttgtacctggtctgtggcgaacgcggtttcttttacacgccaaaaacacgccgcgaagccgaagatcttcaggtggggcaggtggagttggggggcggccccggagctggcagcctccagccacttgcccttgaaggatccctccaaaagcgaggaatcgttgaacagtgctgtacgagcatctgctcattgtaccagcttgagaattactgtaactag

SEQ ID NO: 2608 - DNA, 297 bp, Artificial Sequence
  Description of Artificial Sequence: Synthetic coding sequence
atggccctgtggatgagactactgcccctgctagcgttattagccctatggggacctgaccccgctgcggcctttgttaaccagcacctgtgtggatcgcatctcgtcgaggctctgtacctggtgtgcggggaaagggggtttttttacacacctaaaactcggagagaggcagaagatctgcagggctcccttcagcccttggctctcgagggaagcctgcagaaaagggggatagtcgaacagtgttgcacttctatctgttccctgtaccagctggagaattactgtaattag

SEQ ID NO: 2609 - DNA, 333 bp, Artificial Sequence
  Description of Artificial Sequence: Synthetic coding sequence
atggctctctggatgcggctactgcctctccttgctctgctggccctgtggggccccgaccccgccgctgcatttgtcaatcagcatctgtgcgggtcacatctcgttgaggcgttgtacctggtgtgcggcgaaagaggctttttttacaccgataaaacccgcagggaagctgaagaccttcaagtggggcaagttgagctcggcggcggccctggggccgggagtctacagccacttgcgctcgaaggttctctacagaagaggggcatagtggagcagtgctgtacttcgatttgttccctgtatcagctggagaattactgcaactag

SEQ ID NO: 2610 - DNA, 333 bp, Artificial Sequence
  Description of Artificial Sequence: Synthetic coding sequence
atggccctttggatgcggctgctccccctgctggccttgttagccctgtggggcccagacccagccgccgcgtttgtaaatcagcacctctgcggaagtcatttggtggaggcactctatctcgtgtgtggcgaaaggggctttttctatacccccaaaacccgtcgggaggccgaagatctgcaagtcggccaggtcgaactcgggggaggaccaggagcgggctcactgcaacctctagccctggaggggtctctgcagaagcggggcattgtcgagcagtgctgtacatccatttgtagcttgtatcaactggagaactattgtggatag

SEQ ID NO: 2611 - DNA, 333 bp, Artificial Sequence
  Description of Artificial Sequence: Synthetic coding sequence
atggccctctggatgaggctcctgcctctactggctttgttggccctatgggggcccgacccagctgctgctttcgttaaacagcacctttgcggaagccacctcgtggaggctctttacttggtgtgcggcgagcgcggttttttctacacgcccgagactcgacgtgaggccgaggacctgcaagtaggacaggtggagctcgggggggggccaggagccggctccctccagccattagccctcgaaggcagcctgcagaagcgcggcatcgtagagcagtgctgcaccagcatatgtagtttgtaccagctagagaactactgtaattag

SEQ ID NO: 2612 - DNA, 333 bp, Artificial Sequence
  Description of Artificial Sequence: Synthetic coding sequence
atggctttatggatgcgacttctgccccttctggcgcttctcgccctttggggtcctgacccagctgcggcttttgtcaaccaacatctctgtggcagtcacctggttgaagcactgtacttagtgtgcggggaaagaggcttcttctacactaaacccactcgtagagaggcagaggatttgcaggtcggccaagttgagctggggggaggcccaggggccgggagtctgcagcctctcgcactcgaaggctccctgcagaagcgcggcatagtcgaacagtgttgcacttctatctgttccctatatcaactggaaaactactgtaattag

SEQ ID NO: 2613 - DNA, 570 bp, Artificial Sequence
  Description of Artificial Sequence: Synthetic coding sequence
atggctctcagcttcagccttctgatggccgtgttggttctctcatacaagtcaatttgctctctaggctgcgacctgccccaaacacatagcctgggcaatcgccgcgccctaattctcctgggacagatgggacggataagccccttctcctgcctgaaagatagacacgactttaggattccgcaagaggaatttgacgggaatcagttccaaaaggcacaggcaatatcagtgctgcacgagatgatccaacagacattcaatttgttcagcacagaagatagcagcgcagcatgggagcaatccctactagagaagttttctaccgaactgtatcagcagctcaacgatttggaagcttgtgttattcaggaggtcggggttgaggagacacccttgatgaatgaagatagtatccttgcagtgcggaagtactttcagcgcattaccctgtatcttatcgagcgaaagtacagcccttgcgcgtgggaagtagtaagagcagaaattatgcggtctctgtcattcagtaccaacctgcaaaagagactgcgacgcaaggattag

SEQ ID NO: 2614 - DNA, 573 bp, Artificial Sequence
  Description of Artificial Sequence: Synthetic coding sequence
atgatggcaagcccattcgccctgctgatggctttggtggtgttgtcttgcaaatcatcatgtagcttgggctgcgatttgcctgagacccactctctggataaccggagaaccctgatgctgctcgctcaaatgagtagaatctcaccgtccagttgtctgatggatcgacatgatttcggttttcctcaagaagagtttgatggaaatcaattccagaaagctccagccatcagcgtgctacatgagttgatccagcagatcttcaaccttttcacgacgaaggactcctccgccgcttgggatgaggacctgcttgacaaattctgcaccgagctctaccagcaactcaacgacttggaggcctgcgtgatgcaagaagagcgggtaggtgagactcccttgatgaacgcagattctattctagccgtgaaaaagtatttcaggcgaattactctctacctgacggaaaagaagtattccccatgcgcttgggaagttgtaagggctgagattatgagatcgctgagcctgtccactaacctccaggagcgactgaggcgcaaagaatag

SEQ ID NO: 2615 - DNA, 570 bp, Artificial Sequence
  Description of Artificial Sequence: Synthetic coding sequence
atggcactgccgttcgcacttatgatggccttagtcgtcctgtcctgtaagtccagctgcagcctcggttgtaatctgagtcagactcatagcttgaataaccgaagaacactgatgctgatggcacagatgagacgaatttcccccttttcttgcctgaaagaccgacatgacttcgaattcccgcaggaagagttcgacggaaaccagttccagaaggcacaggccatctctgtcctgcacgagatgatgcaacagactttcaatttattttcaactaagaatagctctgctgcatgggatgagaccctcttagaaaagttctacatcgagctgttccagcagatgaacgatctcgaagcctgtgtgatccaggaagtcggcgtcgaagaaactcctctaatgaatgaggactctatcttggcggtcaaaaagtacttccaacgaattaccctgtatctgatggagaagaaatacagtccgtgtgcctgggaagtagtgagagcagagattatgcgtagcctgagttttagcaccaatttgcaaaaaagactcaggaggaaagattag

SEQ ID NO: 2616 - DNA, 570 bp, Artificial Sequence
  Description of Artificial Sequence: Synthetic coding sequence
atggctttatcattcagtttactgatggcggtgctggtgctgagctacaaatccatttgcagccttggttgtgatctgcctcagactcactctttgggaaatcggcgggccttgatcctccttgcccagatgggccgcataagccactttagttgcctcaaggataggtatgatttcggcttcccccaggaggtgtttgacgggaatcaattccagaaagctcaagcaatctcagcatttcacgagatgattcagcagacattcaatctgttcagcacaaaagattccagtgctgcctgggatgagaccttgttggacaaattctatatcgaattatttcagcagcttaatgacctcgaggcctgtgtcacccaagaagtcggcgtagaggagatagccttaatgaatgaagactctatccttgcagtgcgcaagtacttccagaggatcaccttgtacttaatgggcaaaaagtattccccatgtgcttgggaagtggttcgggccgagatcatgcggtcgttttcattttccacaaatctccagaagggactaaggaggaaagactag

SEQ ID NO: 2617 - DNA, 570 bp, Artificial Sequence
  Description of Artificial Sequence: Synthetic coding sequence
atggcattgtctttctccttgctcatggctgtgcttgttctaagttacaagtccatctgttccctgggttgtgatctgcctcaaacccactctctcggcaatcgccgagcattaatcttgctggctcagatgggtagaatcagtcctttttcctgcctcaaggatagacatgatttcgggcttcctcaggaggagttcgacggaaaccagtttcaaaagacccaggctatcagcgtcctgcatgagatgatccagcaaaccttcaaccttttctccacagaggacagcagcgcagcctgggagcagtcactgctagaaaagttttctaccgagctctaccagcagctgaacaacctggaagcatgtgtcatccaggaggtaggaatggaggagacccctctgatgaacgaggattccattctggccgttaggaaatactttcagaggattacactctacctgacagagaaaaaatattctccatgcgcatgggaggtagtcagagcagagattatgcgcagcctcagtttctctaccaatctgcaaaagatcctgagacgtaaggattag
